United States Patent 11,965,185 (LACHNOSPIRACEAE SP. CAS12A MUTANTS WITH ENHANCED CLEAVAGE ACTIVITY AT NON-CANONICAL TTTT PROTOSPACER ADJACENT MOTIFS) - sequence listing, part 5

SEQ ID NO: 4407 - DNA, 43 bp, Artificial Sequence
  Synthetic
  misc_feature (21)..(22): n is a, c, g, or t
ccgagaaatatgaagatgatnnkcgtaaaagcttcaagaaaat

SEQ ID NO: 4408 - DNA, 43 bp, Artificial Sequence
  Synthetic
  misc_feature (21)..(22): n is a, c, g, or t
agaaatatgaagatgatcgtnnkaaaagcttcaagaaaattgg

SEQ ID NO: 4409 - DNA, 43 bp, Artificial Sequence
  Synthetic
  misc_feature (21)..(22): n is a, c, g, or t
aatatgaagatgatcgtcgtnnkagcttcaagaaaattggtag

SEQ ID NO: 4410 - DNA, 43 bp, Artificial Sequence
  Synthetic
  misc_feature (21)..(22): n is a, c, g, or t
atgaagatgatcgtcgtaaannkttcaagaaaattggtagctt

SEQ ID NO: 4411 - DNA, 43 bp, Artificial Sequence
  Synthetic
  misc_feature (21)..(22): n is a, c, g, or t
aagatgatcgtcgtaaaagcnnkaagaaaattggtagctttag

SEQ ID NO: 4412 - DNA, 43 bp, Artificial Sequence
  Synthetic
  misc_feature (21)..(22): n is a, c, g, or t
atgatcgtcgtaaaagcttcnnkaaaattggtagctttagcct

SEQ ID NO: 4413 - DNA, 43 bp, Artificial Sequence
  Synthetic
  misc_feature (21)..(22): n is a, c, g, or t
atcgtcgtaaaagcttcaagnnkattggtagctttagcctgga

SEQ ID NO: 4414 - DNA, 43 bp, Artificial Sequence
  Synthetic
  misc_feature (21)..(22): n is a, c, g, or t
gtcgtaaaagcttcaagaaannkggtagctttagcctggaaca

SEQ ID NO: 4415 - DNA, 43 bp, Artificial Sequence
  Synthetic
  misc_feature (21)..(22): n is a, c, g, or t
gtaaaagcttcaagaaaattnnkagctttagcctggaacagct

SEQ ID NO: 4416 - DNA, 43 bp, Artificial Sequence
  Synthetic
  misc_feature (21)..(22): n is a, c, g, or t
aaagcttcaagaaaattggtnnktttagcctggaacagctgca

SEQ ID NO: 4417 - DNA, 43 bp, Artificial Sequence
  Synthetic
  misc_feature (21)..(22): n is a, c, g, or t
gcttcaagaaaattggtagcnnkagcctggaacagctgcaaga

SEQ ID NO: 4418 - DNA, 43 bp, Artificial Sequence
  Synthetic
  misc_feature (21)..(22): n is a, c, g, or t
tcaagaaaattggtagctttnnkctggaacagctgcaagaata

SEQ ID NO: 4419 - DNA, 43 bp, Artificial Sequence
  Synthetic
  misc_feature (21)..(22): n is a, c, g, or t
agaaaattggtagctttagcnnkgaacagctgcaagaatatgc

SEQ ID NO: 4420 - DNA, 43 bp, Artificial Sequence
  Synthetic
  misc_feature (21)..(22): n is a, c, g, or t
aaattggtagctttagcctgnnkcagctgcaagaatatgcaga

SEQ ID NO: 4421 - DNA, 43 bp, Artificial Sequence
  Synthetic
  misc_feature (21)..(22): n is a, c, g, or t
ttggtagctttagcctggaannkctgcaagaatatgcagatgc

SEQ ID NO: 4422 - DNA, 43 bp, Artificial Sequence
  Synthetic
  misc_feature (21)..(22): n is a, c, g, or t
gtagctttagcctggaacagnnkcaagaatatgcagatgcaga

SEQ ID NO: 4423 - DNA, 43 bp, Artificial Sequence
  Synthetic
  misc_feature (21)..(22): n is a, c, g, or t
gctttagcctggaacagctgnnkgaatatgcagatgcagatct

SEQ ID NO: 4424 - DNA, 43 bp, Artificial Sequence
  Synthetic
  misc_feature (21)..(22): n is a, c, g, or t
ttagcctggaacagctgcaannktatgcagatgcagatctgag

SEQ ID NO: 4425 - DNA, 43 bp, Artificial Sequence
  Synthetic
  misc_feature (21)..(22): n is a, c, g, or t
gcctggaacagctgcaagaannkgcagatgcagatctgagcgt

SEQ ID NO: 4426 - DNA, 43 bp, Artificial Sequence
  Synthetic
  misc_feature (21)..(22): n is a, c, g, or t
tggaacagctgcaagaatatnnkgatgcagatctgagcgttgt

SEQ ID NO: 4427 - DNA, 43 bp, Artificial Sequence
  Synthetic
  misc_feature (21)..(22): n is a, c, g, or t
aacagctgcaagaatatgcannkgcagatctgagcgttgtgga

SEQ ID NO: 4428 - DNA, 43 bp, Artificial Sequence
  Synthetic
  misc_feature (21)..(22): n is a, c, g, or t
agctgcaagaatatgcagatnnkgatctgagcgttgtggaaaa

SEQ ID NO: 4429 - DNA, 43 bp, Artificial Sequence
  Synthetic
  misc_feature (21)..(22): n is a, c, g, or t
tgcaagaatatgcagatgcannkctgagcgttgtggaaaaact

SEQ ID NO: 4430 - DNA, 43 bp, Artificial Sequence
  Synthetic
  misc_feature (21)..(22): n is a, c, g, or t
aagaatatgcagatgcagatnnkagcgttgtggaaaaactgaa

SEQ ID NO: 4431 - DNA, 43 bp, Artificial Sequence
  Synthetic
  misc_feature (21)..(22): n is a, c, g, or t
aatatgcagatgcagatctgnnkgttgtggaaaaactgaaaga

SEQ ID NO: 4432 - DNA, 43 bp, Artificial Sequence
  Synthetic
  misc_feature (21)..(22): n is a, c, g, or t
atgcagatgcagatctgagcnnkgtggaaaaactgaaagaaat

SEQ ID NO: 4433 - DNA, 43 bp, Artificial Sequence
  Synthetic
  misc_feature (21)..(22): n is a, c, g, or t
cagatgcagatctgagcgttnnkgaaaaactgaaagaaatcat

SEQ ID NO: 4434 - DNA, 43 bp, Artificial Sequence
  Synthetic
  misc_feature (21)..(22): n is a, c, g, or t
atgcagatctgagcgttgtgnnkaaactgaaagaaatcatcat

SEQ ID NO: 4435 - DNA, 43 bp, Artificial Sequence
  Synthetic
  misc_feature (21)..(22): n is a, c, g, or t
cagatctgagcgttgtggaannkctgaaagaaatcatcattca

SEQ ID NO: 4436 - DNA, 43 bp, Artificial Sequence
  Synthetic
  misc_feature (21)..(22): n is a, c, g, or t
atctgagcgttgtggaaaaannkaaagaaatcatcattcagaa

SEQ ID NO: 4437 - DNA, 43 bp, Artificial Sequence
  Synthetic
  misc_feature (21)..(22): n is a, c, g, or t
tgagcgttgtggaaaaactgnnkgaaatcatcattcagaaggt

SEQ ID NO: 4438 - DNA, 43 bp, Artificial Sequence
  Synthetic
  misc_feature (21)..(22): n is a, c, g, or t
gcgttgtggaaaaactgaaannkatcatcattcagaaggtgga

SEQ ID NO: 4439 - DNA, 43 bp, Artificial Sequence
  Synthetic
  misc_feature (21)..(22): n is a, c, g, or t
ttgtggaaaaactgaaagaannkatcattcagaaggtggacga

SEQ ID NO: 4440 - DNA, 43 bp, Artificial Sequence
  Synthetic
  misc_feature (21)..(22): n is a, c, g, or t
tggaaaaactgaaagaaatcnnkattcagaaggtggacgagat

SEQ ID NO: 4441 - DNA, 43 bp, Artificial Sequence
  Synthetic
  misc_feature (21)..(22): n is a, c, g, or t
aaaaactgaaagaaatcatcnnkcagaaggtggacgagatcta

SEQ ID NO: 4442 - DNA, 43 bp, Artificial Sequence
  Synthetic
  misc_feature (21)..(22): n is a, c, g, or t
aactgaaagaaatcatcattnnkaaggtggacgagatctataa

SEQ ID NO: 4443 - DNA, 43 bp, Artificial Sequence
  Synthetic
  misc_feature (21)..(22): n is a, c, g, or t
tgaaagaaatcatcattcagnnkgtggacgagatctataaagt

SEQ ID NO: 4444 - DNA, 43 bp, Artificial Sequence
  Synthetic
  misc_feature (21)..(22): n is a, c, g, or t
aagaaatcatcattcagaagnnkgacgagatctataaagttta

SEQ ID NO: 4445 - DNA, 43 bp, Artificial Sequence
  Synthetic
  misc_feature (21)..(22): n is a, c, g, or t
aaatcatcattcagaaggtgnnkgagatctataaagtttatgg

SEQ ID NO: 4446 - DNA, 43 bp, Artificial Sequence
  Synthetic
  misc_feature (21)..(22): n is a, c, g, or t
tcatcattcagaaggtggacnnkatctataaagtttatggtag

SEQ ID NO: 4447 - DNA, 43 bp, Artificial Sequence
  Synthetic
  misc_feature (21)..(22): n is a, c, g, or t
tcattcagaaggtggacgagnnktataaagtttatggtagcag

SEQ ID NO: 4448 - DNA, 43 bp, Artificial Sequence
  Synthetic
  misc_feature (21)..(22): n is a, c, g, or t
ttcagaaggtggacgagatcnnkaaagtttatggtagcagcga

SEQ ID NO: 4449 - DNA, 43 bp, Artificial Sequence
  Synthetic
  misc_feature (21)..(22): n is a, c, g, or t
agaaggtggacgagatctatnnkgtttatggtagcagcgaaaa

SEQ ID NO: 4450 - DNA, 43 bp, Artificial Sequence
  Synthetic
  misc_feature (21)..(22): n is a, c, g, or t
aggtggacgagatctataaannktatggtagcagcgaaaaact

SEQ ID NO: 4451 - DNA, 43 bp, Artificial Sequence
  Synthetic
  misc_feature (21)..(22): n is a, c, g, or t
tggacgagatctataaagttnnkggtagcagcgaaaaactgtt

SEQ ID NO: 4452 - DNA, 43 bp, Artificial Sequence
  Synthetic
  misc_feature (21)..(22): n is a, c, g, or t
acgagatctataaagtttatnnkagcagcgaaaaactgttcga

SEQ ID NO: 4453 - DNA, 43 bp, Artificial Sequence
  Synthetic
  misc_feature (21)..(22): n is a, c, g, or t
agatctataaagtttatggtnnkagcgaaaaactgttcgatgc

SEQ ID NO: 4454 - DNA, 43 bp, Artificial Sequence
  Synthetic
  misc_feature (21)..(22): n is a, c, g, or t
tctataaagtttatggtagcnnkgaaaaactgttcgatgcaga

SEQ ID NO: 4455 - DNA, 43 bp, Artificial Sequence
  Synthetic
  misc_feature (21)..(22): n is a, c, g, or t
ataaagtttatggtagcagcnnkaaactgttcgatgcagattt

SEQ ID NO: 4456 - DNA, 43 bp, Artificial Sequence
  Synthetic
  misc_feature (21)..(22): n is a, c, g, or t
aagtttatggtagcagcgaannkctgttcgatgcagattttgt

SEQ ID NO: 4457 - DNA, 43 bp, Artificial Sequence
  Synthetic
  misc_feature (21)..(22): n is a, c, g, or t
tttatggtagcagcgaaaaannkttcgatgcagattttgttct

SEQ ID NO: 4458 - DNA, 43 bp, Artificial Sequence
  Synthetic
  misc_feature (21)..(22): n is a, c, g, or t
atggtagcagcgaaaaactgnnkgatgcagattttgttctgga

SEQ ID NO: 4459 - DNA, 43 bp, Artificial Sequence
  Synthetic
  misc_feature (21)..(22): n is a, c, g, or t
gtagcagcgaaaaactgttcnnkgcagattttgttctggaaaa

SEQ ID NO: 4460 - DNA, 43 bp, Artificial Sequence
  Synthetic
  misc_feature (21)..(22): n is a, c, g, or t
gcagcgaaaaactgttcgatnnkgattttgttctggaaaaaag

SEQ ID NO: 4461 - DNA, 43 bp, Artificial Sequence
  Synthetic
  misc_feature (21)..(22): n is a, c, g, or t
gcgaaaaactgttcgatgcannktttgttctggaaaaaagcct

SEQ ID NO: 4462 - DNA, 43 bp, Artificial Sequence
  Synthetic
  misc_feature (21)..(22): n is a, c, g, or t
aaaaactgttcgatgcagatnnkgttctggaaaaaagcctgaa

SEQ ID NO: 4463 - DNA, 43 bp, Artificial Sequence
  Synthetic
  misc_feature (21)..(22): n is a, c, g, or t
aactgttcgatgcagattttnnkctggaaaaaagcctgaaaaa

SEQ ID NO: 4464 - DNA, 43 bp, Artificial Sequence
  Synthetic
  misc_feature (21)..(22): n is a, c, g, or t
tgttcgatgcagattttgttnnkgaaaaaagcctgaaaaagaa

SEQ ID NO: 4465 - DNA, 43 bp, Artificial Sequence
  Synthetic
  misc_feature (21)..(22): n is a, c, g, or t
tcgatgcagattttgttctgnnkaaaagcctgaaaaagaatga

SEQ ID NO: 4466 - DNA, 43 bp, Artificial Sequence
  Synthetic
  misc_feature (21)..(22): n is a, c, g, or t
atgcagattttgttctggaannkagcctgaaaaagaatgatgc

SEQ ID NO: 4467 - DNA, 43 bp, Artificial Sequence
  Synthetic
  misc_feature (21)..(22): n is a, c, g, or t
cagattttgttctggaaaaannkctgaaaaagaatgatgccgt

SEQ ID NO: 4468 - DNA, 43 bp, Artificial Sequence
  Synthetic
  misc_feature (21)..(22): n is a, c, g, or t
attttgttctggaaaaaagcnnkaaaaagaatgatgccgttgt

SEQ ID NO: 4469 - DNA, 43 bp, Artificial Sequence
  Synthetic
  misc_feature (21)..(22): n is a, c, g, or t
ttgttctggaaaaaagcctgnnkaagaatgatgccgttgtggc

SEQ ID NO: 4470 - DNA, 43 bp, Artificial Sequence
  Synthetic
  misc_feature (21)..(22): n is a, c, g, or t
ttctggaaaaaagcctgaaannkaatgatgccgttgtggccat

SEQ ID NO: 4471 - DNA, 43 bp, Artificial Sequence
  Synthetic
  misc_feature (21)..(22): n is a, c, g, or t
tggaaaaaagcctgaaaaagnnkgatgccgttgtggccattat

SEQ ID NO: 4472 - DNA, 43 bp, Artificial Sequence
  Synthetic
  misc_feature (21)..(22): n is a, c, g, or t
aaaaaagcctgaaaaagaatnnkgccgttgtggccattatgaa

SEQ ID NO: 4473 - DNA, 43 bp, Artificial Sequence
  Synthetic
  misc_feature (21)..(22): n is a, c, g, or t
aaagcctgaaaaagaatgatnnkgttgtggccattatgaaaga

SEQ ID NO: 4474 - DNA, 43 bp, Artificial Sequence
  Synthetic
  misc_feature (21)..(22): n is a, c, g, or t
gcctgaaaaagaatgatgccnnkgtggccattatgaaagatct

SEQ ID NO: 4475 - DNA, 43 bp, Artificial Sequence
  Synthetic
  misc_feature (21)..(22): n is a, c, g, or t
tgaaaaagaatgatgccgttnnkgccattatgaaagatctgct

SEQ ID NO: 4476 - DNA, 43 bp, Artificial Sequence
  Synthetic
  misc_feature (21)..(22): n is a, c, g, or t
aaaagaatgatgccgttgtgnnkattatgaaagatctgctgga

SEQ ID NO: 4477 - DNA, 43 bp, Artificial Sequence
  Synthetic
  misc_feature (21)..(22): n is a, c, g, or t
agaatgatgccgttgtggccnnkatgaaagatctgctggatag

SEQ ID NO: 4478 - DNA, 43 bp, Artificial Sequence
  Synthetic
  misc_feature (21)..(22): n is a, c, g, or t
atgatgccgttgtggccattnnkaaagatctgctggatagcgt

SEQ ID NO: 4479 - DNA, 43 bp, Artificial Sequence
  Synthetic
  misc_feature (21)..(22): n is a, c, g, or t
atgccgttgtggccattatgnnkgatctgctggatagcgttaa

SEQ ID NO: 4480 - DNA, 43 bp, Artificial Sequence
  Synthetic
  misc_feature (21)..(22): n is a, c, g, or t
ccgttgtggccattatgaaannkctgctggatagcgttaagag

SEQ ID NO: 4481 - DNA, 43 bp, Artificial Sequence
  Synthetic
  misc_feature (21)..(22): n is a, c, g, or t
ttgtggccattatgaaagatnnkctggatagcgttaagagctt

SEQ ID NO: 4482 - DNA, 43 bp, Artificial Sequence
  Synthetic
  misc_feature (21)..(22): n is a, c, g, or t
tggccattatgaaagatctgnnkgatagcgttaagagcttcga

SEQ ID NO: 4483 - DNA, 43 bp, Artificial Sequence
  Synthetic
  misc_feature (21)..(22): n is a, c, g, or t
ccattatgaaagatctgctgnnkagcgttaagagcttcgagaa

SEQ ID NO: 4484 - DNA, 43 bp, Artificial Sequence
  Synthetic
  misc_feature (21)..(22): n is a, c, g, or t
ttatgaaagatctgctggatnnkgttaagagcttcgagaatta

SEQ ID NO: 4485 - DNA, 43 bp, Artificial Sequence
  Synthetic
  misc_feature (21)..(22): n is a, c, g, or t
tgaaagatctgctggatagcnnkaagagcttcgagaattacat

SEQ ID NO: 4486 - DNA, 43 bp, Artificial Sequence
  Synthetic
  misc_feature (21)..(22): n is a, c, g, or t
aagatctgctggatagcgttnnkagcttcgagaattacatcaa

SEQ ID NO: 4487 - DNA, 43 bp, Artificial Sequence
  Synthetic
  misc_feature (21)..(22): n is a, c, g, or t
atctgctggatagcgttaagnnkttcgagaattacatcaaagc

SEQ ID NO: 4488 - DNA, 43 bp, Artificial Sequence
  Synthetic
  misc_feature (21)..(22): n is a, c, g, or t
tgctggatagcgttaagagcnnkgagaattacatcaaagcctt

SEQ ID NO: 4489 - DNA, 43 bp, Artificial Sequence
  Synthetic
  misc_feature (21)..(22): n is a, c, g, or t
tggatagcgttaagagcttcnnkaattacatcaaagccttttt

SEQ ID NO: 4490 - DNA, 43 bp, Artificial Sequence
  Synthetic
  misc_feature (21)..(22): n is a, c, g, or t
atagcgttaagagcttcgagnnktacatcaaagccttttttgg

SEQ ID NO: 4491 - DNA, 43 bp, Artificial Sequence
  Synthetic
  misc_feature (21)..(22): n is a, c, g, or t
gcgttaagagcttcgagaatnnkatcaaagccttttttggtga

SEQ ID NO: 4492 - DNA, 43 bp, Artificial Sequence
  Synthetic
  misc_feature (21)..(22): n is a, c, g, or t
ttaagagcttcgagaattacnnkaaagccttttttggtgaggg

SEQ ID NO: 4493 - DNA, 43 bp, Artificial Sequence
  Synthetic
  misc_feature (21)..(22): n is a, c, g, or t
agagcttcgagaattacatcnnkgccttttttggtgagggcaa

SEQ ID NO: 4494 - DNA, 43 bp, Artificial Sequence
  Synthetic
  misc_feature (21)..(22): n is a, c, g, or t
gcttcgagaattacatcaaannkttttttggtgagggcaaaga

SEQ ID NO: 4495 - DNA, 43 bp, Artificial Sequence
  Synthetic
  misc_feature (21)..(22): n is a, c, g, or t
tcgagaattacatcaaagccnnktttggtgagggcaaagaaac

SEQ ID NO: 4496 - DNA, 43 bp, Artificial Sequence
  Synthetic
  misc_feature (21)..(22): n is a, c, g, or t
agaattacatcaaagcctttnnkggtgagggcaaagaaaccaa

SEQ ID NO: 4497 - DNA, 43 bp, Artificial Sequence
  Synthetic
  misc_feature (21)..(22): n is a, c, g, or t
attacatcaaagccttttttnnkgagggcaaagaaaccaatcg

SEQ ID NO: 4498 - DNA, 43 bp, Artificial Sequence
  Synthetic
  misc_feature (21)..(22): n is a, c, g, or t
acatcaaagccttttttggtnnkggcaaagaaaccaatcgtga

SEQ ID NO: 4499 - DNA, 43 bp, Artificial Sequence
  Synthetic
  misc_feature (21)..(22): n is a, c, g, or t
tcaaagccttttttggtgagnnkaaagaaaccaatcgtgatga

SEQ ID NO: 4500 - DNA, 43 bp, Artificial Sequence
  Synthetic
  misc_feature (21)..(22): n is a, c, g, or t
aagccttttttggtgagggcnnkgaaaccaatcgtgatgaaag

SEQ ID NO: 4501 - DNA, 43 bp, Artificial Sequence
  Synthetic
  misc_feature (21)..(22): n is a, c, g, or t
ccttttttggtgagggcaaannkaccaatcgtgatgaaagttt

SEQ ID NO: 4502 - DNA, 43 bp, Artificial Sequence
  Synthetic
  misc_feature (21)..(22): n is a, c, g, or t
tttttggtgagggcaaagaannkaatcgtgatgaaagtttcta

SEQ ID NO: 4503 - DNA, 43 bp, Artificial Sequence
  Synthetic
  misc_feature (21)..(22): n is a, c, g, or t
ttggtgagggcaaagaaaccnnkcgtgatgaaagtttctatgg

SEQ ID NO: 4504 - DNA, 43 bp, Artificial Sequence
  Synthetic
  misc_feature (21)..(22): n is a, c, g, or t
gtgagggcaaagaaaccaatnnkgatgaaagtttctatggcga

SEQ ID NO: 4505 - DNA, 43 bp, Artificial Sequence
  Synthetic
  misc_feature (21)..(22): n is a, c, g, or t
agggcaaagaaaccaatcgtnnkgaaagtttctatggcgattt

SEQ ID NO: 4506 - DNA, 43 bp, Artificial Sequence
  Synthetic
  misc_feature (21)..(22): n is a, c, g, or t
gcaaagaaaccaatcgtgatnnkagtttctatggcgattttgt

SEQ ID NO: 4507 - DNA, 43 bp, Artificial Sequence
  Synthetic
  misc_feature (21)..(22): n is a, c, g, or t
aagaaaccaatcgtgatgaannkttctatggcgattttgtgct

SEQ ID NO: 4508 - DNA, 43 bp, Artificial Sequence
  Synthetic
  misc_feature (21)..(22): n is a, c, g, or t
aaaccaatcgtgatgaaagtnnktatggcgattttgtgctggc

SEQ ID NO: 4509 - DNA, 43 bp, Artificial Sequence
  Synthetic
  misc_feature (21)..(22): n is a, c, g, or t
ccaatcgtgatgaaagtttcnnkggcgattttgtgctggccta

SEQ ID NO: 4510 - DNA, 43 bp, Artificial Sequence
  Synthetic
  misc_feature (21)..(22): n is a, c, g, or t
atcgtgatgaaagtttctatnnkgattttgtgctggcctatga

SEQ ID NO: 4511 - DNA, 43 bp, Artificial Sequence
  Synthetic
  misc_feature (21)..(22): n is a, c, g, or t
gtgatgaaagtttctatggcnnktttgtgctggcctatgatat

SEQ ID NO: 4512 - DNA, 43 bp, Artificial Sequence
  Synthetic
  misc_feature (21)..(22): n is a, c, g, or t
atgaaagtttctatggcgatnnkgtgctggcctatgatattct

SEQ ID NO: 4513 - DNA, 43 bp, Artificial Sequence
  Synthetic
  misc_feature (21)..(22): n is a, c, g, or t
aaagtttctatggcgattttnnkctggcctatgatattctgct

SEQ ID NO: 4514 - DNA, 43 bp, Artificial Sequence
  Synthetic
  misc_feature (21)..(22): n is a, c, g, or t
gtttctatggcgattttgtgnnkgcctatgatattctgctgaa

SEQ ID NO: 4515 - DNA, 43 bp, Artificial Sequence
  Synthetic
  misc_feature (21)..(22): n is a, c, g, or t
tctatggcgattttgtgctgnnktatgatattctgctgaaagt

SEQ ID NO: 4516 - DNA, 43 bp, Artificial Sequence
  Synthetic
  misc_feature (21)..(22): n is a, c, g, or t
atggcgattttgtgctggccnnkgatattctgctgaaagtgga

SEQ ID NO: 4517 - DNA, 43 bp, Artificial Sequence
  Synthetic
  misc_feature (21)..(22): n is a, c, g, or t
gcgattttgtgctggcctatnnkattctgctgaaagtggacca

SEQ ID NO: 4518 - DNA, 43 bp, Artificial Sequence
  Synthetic
  misc_feature (21)..(22): n is a, c, g, or t
attttgtgctggcctatgatnnkctgctgaaagtggaccatat

SEQ ID NO: 4519 - DNA, 43 bp, Artificial Sequence
  Synthetic
  misc_feature (21)..(22): n is a, c, g, or t
ttgtgctggcctatgatattnnkctgaaagtggaccatattta

SEQ ID NO: 4520 - DNA, 43 bp, Artificial Sequence
  Synthetic
  misc_feature (21)..(22): n is a, c, g, or t
tgctggcctatgatattctgnnkaaagtggaccatatttatga

SEQ ID NO: 4521 - DNA, 43 bp, Artificial Sequence
  Synthetic
  misc_feature (21)..(22): n is a, c, g, or t
tggcctatgatattctgctgnnkgtggaccatatttatgatgc

SEQ ID NO: 4522 - DNA, 43 bp, Artificial Sequence
  Synthetic
  misc_feature (21)..(22): n is a, c, g, or t
cctatgatattctgctgaaannkgaccatatttatgatgccat

SEQ ID NO: 4523 - DNA, 43 bp, Artificial Sequence
  Synthetic
  misc_feature (21)..(22): n is a, c, g, or t
atgatattctgctgaaagtgnnkcatatttatgatgccattcg

SEQ ID NO: 4524 - DNA, 43 bp, Artificial Sequence
  Synthetic
  misc_feature (21)..(22): n is a, c, g, or t
atattctgctgaaagtggacnnkatttatgatgccattcgcaa

SEQ ID NO: 4525 - DNA, 43 bp, Artificial Sequence
  Synthetic
  misc_feature (21)..(22): n is a, c, g, or t
ttctgctgaaagtggaccatnnktatgatgccattcgcaatta

SEQ ID NO: 4526 - DNA, 43 bp, Artificial Sequence
  Synthetic
  misc_feature (21)..(22): n is a, c, g, or t
tgctgaaagtggaccatattnnkgatgccattcgcaattatgt

SEQ ID NO: 4527 - DNA, 43 bp, Artificial Sequence
  Synthetic
  misc_feature (21)..(22): n is a, c, g, or t
tgaaagtggaccatatttatnnkgccattcgcaattatgttac

SEQ ID NO: 4528 - DNA, 43 bp, Artificial Sequence
  Synthetic
  misc_feature (21)..(22): n is a, c, g, or t
aagtggaccatatttatgatnnkattcgcaattatgttaccca

SEQ ID NO: 4529 - DNA, 43 bp, Artificial Sequence
  Synthetic
  misc_feature (21)..(22): n is a, c, g, or t
tggaccatatttatgatgccnnkcgcaattatgttacccagaa

SEQ ID NO: 4530 - DNA, 43 bp, Artificial Sequence
  Synthetic
  misc_feature (21)..(22): n is a, c, g, or t
accatatttatgatgccattnnkaattatgttacccagaaacc

SEQ ID NO: 4531 - DNA, 43 bp, Artificial Sequence
  Synthetic
  misc_feature (21)..(22): n is a, c, g, or t
atatttatgatgccattcgcnnktatgttacccagaaaccgta

SEQ ID NO: 4532 - DNA, 43 bp, Artificial Sequence
  Synthetic
  misc_feature (21)..(22): n is a, c, g, or t
tttatgatgccattcgcaatnnkgttacccagaaaccgtatag

SEQ ID NO: 4533 - DNA, 43 bp, Artificial Sequence
  Synthetic
  misc_feature (21)..(22): n is a, c, g, or t
atgatgccattcgcaattatnnkacccagaaaccgtatagcaa

SEQ ID NO: 4534 - DNA, 43 bp, Artificial Sequence
  Synthetic
  misc_feature (21)..(22): n is a, c, g, or t
atgccattcgcaattatgttnnkcagaaaccgtatagcaaaga

SEQ ID NO: 4535 - DNA, 43 bp, Artificial Sequence
  Synthetic
  misc_feature (21)..(22): n is a, c, g, or t
ccattcgcaattatgttaccnnkaaaccgtatagcaaagacaa

SEQ ID NO: 4536 - DNA, 43 bp, Artificial Sequence
  Synthetic
  misc_feature (21)..(22): n is a, c, g, or t
ttcgcaattatgttacccagnnkccgtatagcaaagacaagtt

SEQ ID NO: 4537 - DNA, 43 bp, Artificial Sequence
  Synthetic
  misc_feature (21)..(22): n is a, c, g, or t
gcaattatgttacccagaaannktatagcaaagacaagttcaa

SEQ ID NO: 4538 - DNA, 43 bp, Artificial Sequence
  Synthetic
  misc_feature (21)..(22): n is a, c, g, or t
attatgttacccagaaaccgnnkagcaaagacaagttcaaact

SEQ ID NO: 4539 - DNA, 43 bp, Artificial Sequence
  Synthetic
  misc_feature (21)..(22): n is a, c, g, or t
atgttacccagaaaccgtatnnkaaagacaagttcaaactgta

SEQ ID NO: 4540 - DNA, 43 bp, Artificial Sequence
  Synthetic
  misc_feature (21)..(22): n is a, c, g, or t
ttacccagaaaccgtatagcnnkgacaagttcaaactgtactt

SEQ ID NO: 4541 - DNA, 43 bp, Artificial Sequence
  Synthetic
  misc_feature (21)..(22): n is a, c, g, or t
cccagaaaccgtatagcaaannkaagttcaaactgtactttca

SEQ ID NO: 4542 - DNA, 43 bp, Artificial Sequence
  Synthetic
  misc_feature (21)..(22): n is a, c, g, or t
agaaaccgtatagcaaagacnnkttcaaactgtactttcagaa

SEQ ID NO: 4543 - DNA, 43 bp, Artificial Sequence
  Synthetic
  misc_feature (21)..(22): n is a, c, g, or t
aaccgtatagcaaagacaagnnkaaactgtactttcagaaccc

SEQ ID NO: 4544 - DNA, 43 bp, Artificial Sequence
  Synthetic
  misc_feature (21)..(22): n is a, c, g, or t
cgtatagcaaagacaagttcnnkctgtactttcagaacccgca

SEQ ID NO: 4545 - DNA, 43 bp, Artificial Sequence
  Synthetic
  misc_feature (21)..(22): n is a, c, g, or t
atagcaaagacaagttcaaannktactttcagaacccgcagtt

SEQ ID NO: 4546 - DNA, 43 bp, Artificial Sequence
  Synthetic
  misc_feature (21)..(22): n is a, c, g, or t
gcaaagacaagttcaaactgnnktttcagaacccgcagtttat

SEQ ID NO: 4547 - DNA, 43 bp, Artificial Sequence
  Synthetic
  misc_feature (21)..(22): n is a, c, g, or t
aagacaagttcaaactgtacnnkcagaacccgcagtttatggg

SEQ ID NO: 4548 - DNA, 43 bp, Artificial Sequence
  Synthetic
  misc_feature (21)..(22): n is a, c, g, or t
acaagttcaaactgtactttnnkaacccgcagtttatgggtgg

SEQ ID NO: 4549 - DNA, 43 bp, Artificial Sequence
  Synthetic
  misc_feature (21)..(22): n is a, c, g, or t
agttcaaactgtactttcagnnkccgcagtttatgggtggttg

SEQ ID NO: 4550 - DNA, 43 bp, Artificial Sequence
  Synthetic
  misc_feature (21)..(22): n is a, c, g, or t
tcaaactgtactttcagaacnnkcagtttatgggtggttggga

SEQ ID NO: 4551 - DNA, 43 bp, Artificial Sequence
  Synthetic
  misc_feature (21)..(22): n is a, c, g, or t
aactgtactttcagaacccgnnktttatgggtggttgggataa

SEQ ID NO: 4552 - DNA, 43 bp, Artificial Sequence
  Synthetic
  misc_feature (21)..(22): n is a, c, g, or t
tgtactttcagaacccgcagnnkatgggtggttgggataaaga

SEQ ID NO: 4553 - DNA, 43 bp, Artificial Sequence
  Synthetic
  misc_feature (21)..(22): n is a, c, g, or t
actttcagaacccgcagtttnnkggtggttgggataaagataa

SEQ ID NO: 4554 - DNA, 43 bp, Artificial Sequence
  Synthetic
  misc_feature (21)..(22): n is a, c, g, or t
ttcagaacccgcagtttatgnnkggttgggataaagataaaga

SEQ ID NO: 4555 - DNA, 43 bp, Artificial Sequence
  Synthetic
  misc_feature (21)..(22): n is a, c, g, or t
agaacccgcagtttatgggtnnktgggataaagataaagaaac

SEQ ID NO: 4556 - DNA, 43 bp, Artificial Sequence
  Synthetic
  misc_feature (21)..(22): n is a, c, g, or t
acccgcagtttatgggtggtnnkgataaagataaagaaaccga

SEQ ID NO: 4557 - DNA, 43 bp, Artificial Sequence
  Synthetic
  misc_feature (21)..(22): n is a, c, g, or t
cgcagtttatgggtggttggnnkaaagataaagaaaccgatta

SEQ ID NO: 4558 - DNA, 43 bp, Artificial Sequence
  Synthetic
  misc_feature (21)..(22): n is a, c, g, or t
agtttatgggtggttgggatnnkgataaagaaaccgattatcg

SEQ ID NO: 4559 - DNA, 43 bp, Artificial Sequence
  Synthetic
  misc_feature (21)..(22): n is a, c, g, or t
ttatgggtggttgggataaannkaaagaaaccgattatcgtgc

SEQ ID NO: 4560 - DNA, 43 bp, Artificial Sequence
  Synthetic
  misc_feature (21)..(22): n is a, c, g, or t
tgggtggttgggataaagatnnkgaaaccgattatcgtgccac

SEQ ID NO: 4561 - DNA, 43 bp, Artificial Sequence
  Synthetic
  misc_feature (21)..(22): n is a, c, g, or t
gtggttgggataaagataaannkaccgattatcgtgccaccat

SEQ ID NO: 4562 - DNA, 43 bp, Artificial Sequence
  Synthetic
  misc_feature (21)..(22): n is a, c, g, or t
gttgggataaagataaagaannkgattatcgtgccaccatcct

SEQ ID NO: 4563 - DNA, 43 bp, Artificial Sequence
  Synthetic
  misc_feature (21)..(22): n is a, c, g, or t
gggataaagataaagaaaccnnktatcgtgccaccatcctgcg

SEQ ID NO: 4564 - DNA, 43 bp, Artificial Sequence
  Synthetic
  misc_feature (21)..(22): n is a, c, g, or t
ataaagataaagaaaccgatnnkcgtgccaccatcctgcgtta

SEQ ID NO: 4565 - DNA, 43 bp, Artificial Sequence
  Synthetic
  misc_feature (21)..(22): n is a, c, g, or t
aagataaagaaaccgattatnnkgccaccatcctgcgttatgg

SEQ ID NO: 4566 - DNA, 43 bp, Artificial Sequence
  Synthetic
  misc_feature (21)..(22): n is a, c, g, or t
ataaagaaaccgattatcgtnnkaccatcctgcgttatggtag

SEQ ID NO: 4567 - DNA, 43 bp, Artificial Sequence
  Synthetic
  misc_feature (21)..(22): n is a, c, g, or t
aagaaaccgattatcgtgccnnkatcctgcgttatggtagtaa

SEQ ID NO: 4568 - DNA, 43 bp, Artificial Sequence
  Synthetic
  misc_feature (21)..(22): n is a, c, g, or t
aaaccgattatcgtgccaccnnkctgcgttatggtagtaaata

SEQ ID NO: 4569 - DNA, 43 bp, Artificial Sequence
  Synthetic
  misc_feature (21)..(22): n is a, c, g, or t
ccgattatcgtgccaccatcnnkcgttatggtagtaaatacta

SEQ ID NO: 4570 - DNA, 43 bp, Artificial Sequence
  Synthetic
  misc_feature (21)..(22): n is a, c, g, or t
attatcgtgccaccatcctgnnktatggtagtaaatactatct

SEQ ID NO: 4571 - DNA, 43 bp, Artificial Sequence
  Synthetic
  misc_feature (21)..(22): n is a, c, g, or t
atcgtgccaccatcctgcgtnnkggtagtaaatactatctggc

SEQ ID NO: 4572 - DNA, 43 bp, Artificial Sequence
  Synthetic
  misc_feature (21)..(22): n is a, c, g, or t
gtgccaccatcctgcgttatnnkagtaaatactatctggccat

SEQ ID NO: 4573 - DNA, 43 bp, Artificial Sequence
  Synthetic
  misc_feature (21)..(22): n is a, c, g, or t
ccaccatcctgcgttatggtnnkaaatactatctggccatcat

SEQ ID NO: 4574 - DNA, 43 bp, Artificial Sequence
  Synthetic
  misc_feature (21)..(22): n is a, c, g, or t
ccatcctgcgttatggtagtnnktactatctggccatcatgga

SEQ ID NO: 4575 - DNA, 43 bp, Artificial Sequence
  Synthetic
  misc_feature (21)..(22): n is a, c, g, or t
tcctgcgttatggtagtaaannktatctggccatcatggacaa

SEQ ID NO: 4576 - DNA, 43 bp, Artificial Sequence
  Synthetic
  misc_feature (21)..(22): n is a, c, g, or t
tgcgttatggtagtaaatacnnkctggccatcatggacaaaaa

SEQ ID NO: 4577 - DNA, 43 bp, Artificial Sequence
  Synthetic
  misc_feature (21)..(22): n is a, c, g, or t
gttatggtagtaaatactatnnkgccatcatggacaaaaaata

SEQ ID NO: 4578 - DNA, 43 bp, Artificial Sequence
  Synthetic
  misc_feature (21)..(22): n is a, c, g, or t
atggtagtaaatactatctgnnkatcatggacaaaaaatacgc

SEQ ID NO: 4579 - DNA, 43 bp, Artificial Sequence
  Synthetic
  misc_feature (21)..(22): n is a, c, g, or t
gtagtaaatactatctggccnnkatggacaaaaaatacgcaaa

SEQ ID NO: 4580 - DNA, 43 bp, Artificial Sequence
  Synthetic
  misc_feature (21)..(22): n is a, c, g, or t
gtaaatactatctggccatcnnkgacaaaaaatacgcaaaatg

SEQ ID NO: 4581 - DNA, 43 bp, Artificial Sequence
  Synthetic
  misc_feature (21)..(22): n is a, c, g, or t
aatactatctggccatcatgnnkaaaaaatacgcaaaatgcct

SEQ ID NO: 4582 - DNA, 43 bp, Artificial Sequence
  Synthetic
  misc_feature (21)..(22): n is a, c, g, or t
actatctggccatcatggacnnkaaatacgcaaaatgcctgca

SEQ ID NO: 4583 - DNA, 43 bp, Artificial Sequence
  Synthetic
  misc_feature (21)..(22): n is a, c, g, or t
atctggccatcatggacaaannktacgcaaaatgcctgcagaa

SEQ ID NO: 4584 - DNA, 43 bp, Artificial Sequence
  Synthetic
  misc_feature (21)..(22): n is a, c, g, or t
tggccatcatggacaaaaaannkgcaaaatgcctgcagaaaat

SEQ ID NO: 4585 - DNA, 43 bp, Artificial Sequence
  Synthetic
  misc_feature (21)..(22): n is a, c, g, or t
ccatcatggacaaaaaatacnnkaaatgcctgcagaaaatcga

SEQ ID NO: 4586 - DNA, 43 bp, Artificial Sequence
  Synthetic
  misc_feature (21)..(22): n is a, c, g, or t
tcatggacaaaaaatacgcannktgcctgcagaaaatcgacaa

SEQ ID NO: 4587 - DNA, 43 bp, Artificial Sequence
  Synthetic
  misc_feature (21)..(22): n is a, c, g, or t
tggacaaaaaatacgcaaaannkctgcagaaaatcgacaaaga

SEQ ID NO: 4588 - DNA, 43 bp, Artificial Sequence
  Synthetic
  misc_feature (21)..(22): n is a, c, g, or t
acaaaaaatacgcaaaatgcnnkcagaaaatcgacaaagatga

SEQ ID NO: 4589 - DNA, 43 bp, Artificial Sequence
  Synthetic
  misc_feature (21)..(22): n is a, c, g, or t
aaaaatacgcaaaatgcctgnnkaaaatcgacaaagatgatgt

SEQ ID NO: 4590 - DNA, 43 bp, Artificial Sequence
  Synthetic
  misc_feature (21)..(22): n is a, c, g, or t
aatacgcaaaatgcctgcagnnkatcgacaaagatgatgtgaa

SEQ ID NO: 4591 - DNA, 43 bp, Artificial Sequence
  Synthetic
  misc_feature (21)..(22): n is a, c, g, or t
acgcaaaatgcctgcagaaannkgacaaagatgatgtgaatgg

SEQ ID NO: 4592 - DNA, 43 bp, Artificial Sequence
  Synthetic
  misc_feature (21)..(22): n is a, c, g, or t
caaaatgcctgcagaaaatcnnkaaagatgatgtgaatggcaa

SEQ ID NO: 4593 - DNA, 43 bp, Artificial Sequence
  Synthetic
  misc_feature (21)..(22): n is a, c, g, or t
aatgcctgcagaaaatcgacnnkgatgatgtgaatggcaacta

SEQ ID NO: 4594 - DNA, 43 bp, Artificial Sequence
  Synthetic
  misc_feature (21)..(22): n is a, c, g, or t
gcctgcagaaaatcgacaaannkgatgtgaatggcaactatga

SEQ ID NO: 4595 - DNA, 43 bp, Artificial Sequence
  Synthetic
  misc_feature (21)..(22): n is a, c, g, or t
tgcagaaaatcgacaaagatnnkgtgaatggcaactatgaaaa

SEQ ID NO: 4596 - DNA, 43 bp, Artificial Sequence
  Synthetic
  misc_feature (21)..(22): n is a, c, g, or t
agaaaatcgacaaagatgatnnkaatggcaactatgaaaaaat

SEQ ID NO: 4597 - DNA, 43 bp, Artificial Sequence
  Synthetic
  misc_feature (21)..(22): n is a, c, g, or t
aaatcgacaaagatgatgtgnnkggcaactatgaaaaaatcaa

SEQ ID NO: 4598 - DNA, 43 bp, Artificial Sequence
  Synthetic
  misc_feature (21)..(22): n is a, c, g, or t
tcgacaaagatgatgtgaatnnkaactatgaaaaaatcaacta

SEQ ID NO: 4599 - DNA, 43 bp, Artificial Sequence
  Synthetic
  misc_feature (21)..(22): n is a, c, g, or t
acaaagatgatgtgaatggcnnktatgaaaaaatcaactacaa

SEQ ID NO: 4600 - DNA, 43 bp, Artificial Sequence
  Synthetic
  misc_feature (21)..(22): n is a, c, g, or t
aagatgatgtgaatggcaacnnkgaaaaaatcaactacaaact

SEQ ID NO: 4601 - DNA, 43 bp, Artificial Sequence
  Synthetic
  misc_feature (21)..(22): n is a, c, g, or t
atgatgtgaatggcaactatnnkaaaatcaactacaaactgct

SEQ ID NO: 4602 - DNA, 43 bp, Artificial Sequence
  Synthetic
  misc_feature (21)..(22): n is a, c, g, or t
atgtgaatggcaactatgaannkatcaactacaaactgctgcc

SEQ ID NO: 4603 - DNA, 43 bp, Artificial Sequence
  Synthetic
  misc_feature (21)..(22): n is a, c, g, or t
tgaatggcaactatgaaaaannkaactacaaactgctgcctgg

SEQ ID NO: 4604 - DNA, 43 bp, Artificial Sequence
  Synthetic
  misc_feature (21)..(22): n is a, c, g, or t
atggcaactatgaaaaaatcnnktacaaactgctgcctggtcc

SEQ ID NO: 4605 - DNA, 43 bp, Artificial Sequence
  Synthetic
  misc_feature (21)..(22): n is a, c, g, or t
gcaactatgaaaaaatcaacnnkaaactgctgcctggtccgaa

SEQ ID NO: 4606 - DNA, 43 bp, Artificial Sequence
  Synthetic
  misc_feature (21)..(22): n is a, c, g, or t
actatgaaaaaatcaactacnnkctgctgcctggtccgaataa

SEQ ID NO: 4607 - DNA, 43 bp, Artificial Sequence
  Synthetic
  misc_feature (21)..(22): n is a, c, g, or t
atgaaaaaatcaactacaaannkctgcctggtccgaataaaat

SEQ ID NO: 4608 - DNA, 43 bp, Artificial Sequence
  Synthetic
  misc_feature (21)..(22): n is a, c, g, or t
aaaaaatcaactacaaactgnnkcctggtccgaataaaatgct

SEQ ID NO: 4609 - DNA, 43 bp, Artificial Sequence
  Synthetic
  misc_feature (21)..(22): n is a, c, g, or t
aaatcaactacaaactgctgnnkggtccgaataaaatgctgcc

SEQ ID NO: 4610 - DNA, 43 bp, Artificial Sequence
  Synthetic
  misc_feature (21)..(22): n is a, c, g, or t
tcaactacaaactgctgcctnnkccgaataaaatgctgccgaa

SEQ ID NO: 4611 - DNA, 43 bp, Artificial Sequence
  Synthetic
  misc_feature (21)..(22): n is a, c, g, or t
actacaaactgctgcctggtnnkaataaaatgctgccgaaagt

SEQ ID NO: 4612 - DNA, 43 bp, Artificial Sequence
  Synthetic
  misc_feature (21)..(22): n is a, c, g, or t
acaaactgctgcctggtccgnnkaaaatgctgccgaaagtgtt

SEQ ID NO: 4613 - DNA, 43 bp, Artificial Sequence
  Synthetic
  misc_feature (21)..(22): n is a, c, g, or t
aactgctgcctggtccgaatnnkatgctgccgaaagtgttctt

SEQ ID NO: 4614 - DNA, 43 bp, Artificial Sequence
  Synthetic
  misc_feature (21)..(22): n is a, c, g, or t
tgctgcctggtccgaataaannkctgccgaaagtgttctttag

SEQ ID NO: 4615 - DNA, 43 bp, Artificial Sequence
  Synthetic
  misc_feature (21)..(22): n is a, c, g, or t
tgcctggtccgaataaaatgnnkccgaaagtgttctttagcaa

SEQ ID NO: 4616 - DNA, 43 bp, Artificial Sequence
  Synthetic
  misc_feature (21)..(22): n is a, c, g, or t
ctggtccgaataaaatgctgnnkaaagtgttctttagcaagaa

SEQ ID NO: 4617 - DNA, 43 bp, Artificial Sequence
  Synthetic
  misc_feature (21)..(22): n is a, c, g, or t
gtccgaataaaatgctgccgnnkgtgttctttagcaagaaatg

SEQ ID NO: 4618 - DNA, 43 bp, Artificial Sequence
  Synthetic
  misc_feature (21)..(22): n is a, c, g, or t
cgaataaaatgctgccgaaannkttctttagcaagaaatggat

SEQ ID NO: 4619 - DNA, 43 bp, Artificial Sequence
  Synthetic
  misc_feature (21)..(22): n is a, c, g, or t
ataaaatgctgccgaaagtgnnktttagcaagaaatggatggc

SEQ ID NO: 4620 - DNA, 43 bp, Artificial Sequence
  Synthetic
  misc_feature (21)..(22): n is a, c, g, or t
aaatgctgccgaaagtgttcnnkagcaagaaatggatggccta

SEQ ID NO: 4621 - DNA, 43 bp, Artificial Sequence
  Synthetic
  misc_feature (21)..(22): n is a, c, g, or t
tgctgccgaaagtgttctttnnkaagaaatggatggcctatta

SEQ ID NO: 4622 - DNA, 43 bp, Artificial Sequence
  Synthetic
  misc_feature (21)..(22): n is a, c, g, or t
tgccgaaagtgttctttagcnnkaaatggatggcctattataa

SEQ ID NO: 4623 - DNA, 43 bp, Artificial Sequence
  Synthetic
  misc_feature (21)..(22): n is a, c, g, or t
cgaaagtgttctttagcaagnnktggatggcctattataaccc

SEQ ID NO: 4624 - DNA, 43 bp, Artificial Sequence
  Synthetic
  misc_feature (21)..(22): n is a, c, g, or t
aagtgttctttagcaagaaannkatggcctattataacccgag

SEQ ID NO: 4625 - DNA, 43 bp, Artificial Sequence
  Synthetic
  misc_feature (21)..(22): n is a, c, g, or t
tgttctttagcaagaaatggnnkgcctattataacccgagcga

SEQ ID NO: 4626 - DNA, 43 bp, Artificial Sequence
  Synthetic
  misc_feature (21)..(22): n is a, c, g, or t
tctttagcaagaaatggatgnnktattataacccgagcgagga

SEQ ID NO: 4627 - DNA, 43 bp, Artificial Sequence
  Synthetic
  misc_feature (21)..(22): n is a, c, g, or t
ttagcaagaaatggatggccnnktataacccgagcgaggatat

SEQ ID NO: 4628 - DNA, 43 bp, Artificial Sequence
  Synthetic
  misc_feature (21)..(22): n is a, c, g, or t
gcaagaaatggatggcctatnnkaacccgagcgaggatattca

SEQ ID NO: 4629 - DNA, 43 bp, Artificial Sequence
  Synthetic
  misc_feature (21)..(22): n is a, c, g, or t
agaaatggatggcctattatnnkccgagcgaggatattcaaaa

SEQ ID NO: 4630 - DNA, 43 bp, Artificial Sequence
  Synthetic
  misc_feature (21)..(22): n is a, c, g, or t
aatggatggcctattataacnnkagcgaggatattcaaaagat

SEQ ID NO: 4631 - DNA, 43 bp, Artificial Sequence
  Synthetic
  misc_feature (21)..(22): n is a, c, g, or t
ggatggcctattataacccgnnkgaggatattcaaaagatcta

SEQ ID NO: 4632 - DNA, 43 bp, Artificial Sequence
  Synthetic
  misc_feature (21)..(22): n is a, c, g, or t
tggcctattataacccgagcnnkgatattcaaaagatctacaa

SEQ ID NO: 4633 - DNA, 43 bp, Artificial Sequence
  Synthetic
  misc_feature (21)..(22): n is a, c, g, or t
cctattataacccgagcgagnnkattcaaaagatctacaaaaa

SEQ ID NO: 4634 - DNA, 43 bp, Artificial Sequence
  Synthetic
  misc_feature (21)..(22): n is a, c, g, or t
attataacccgagcgaggatnnkcaaaagatctacaaaaatgg

SEQ ID NO: 4635 - DNA, 43 bp, Artificial Sequence
  Synthetic
  misc_feature (21)..(22): n is a, c, g, or t
ataacccgagcgaggatattnnkaagatctacaaaaatggcac

SEQ ID NO: 4636 - DNA, 43 bp, Artificial Sequence
  Synthetic
  misc_feature (21)..(22): n is a, c, g, or t
acccgagcgaggatattcaannkatctacaaaaatggcacctt

SEQ ID NO: 4637 - DNA, 43 bp, Artificial Sequence
  Synthetic
  misc_feature (21)..(22): n is a, c, g, or t
cgagcgaggatattcaaaagnnktacaaaaatggcacctttaa

SEQ ID NO: 4638 - DNA, 43 bp, Artificial Sequence
  Synthetic
  misc_feature (21)..(22): n is a, c, g, or t
gcgaggatattcaaaagatcnnkaaaaatggcacctttaaaaa

SEQ ID NO: 4639 - DNA, 43 bp, Artificial Sequence
  Synthetic
  misc_feature (21)..(22): n is a, c, g, or t
aggatattcaaaagatctacnnkaatggcacctttaaaaaggg

SEQ ID NO: 4640 - DNA, 43 bp, Artificial Sequence
  Synthetic
  misc_feature (21)..(22): n is a, c, g, or t
atattcaaaagatctacaaannkggcacctttaaaaagggcga

SEQ ID NO: 4641 - DNA, 43 bp, Artificial Sequence
  Synthetic
  misc_feature (21)..(22): n is a, c, g, or t
ttcaaaagatctacaaaaatnnkacctttaaaaagggcgacat

SEQ ID NO: 4642 - DNA, 43 bp, Artificial Sequence
  Synthetic
  misc_feature (21)..(22): n is a, c, g, or t
aaaagatctacaaaaatggcnnktttaaaaagggcgacatgtt

SEQ ID NO: 4643 - DNA, 43 bp, Artificial Sequence
  Synthetic
  misc_feature (21)..(22): n is a, c, g, or t
agatctacaaaaatggcaccnnkaaaaagggcgacatgttcaa

SEQ ID NO: 4644 - DNA, 43 bp, Artificial Sequence
  Synthetic
  misc_feature (21)..(22): n is a, c, g, or t
tctacaaaaatggcacctttnnkaagggcgacatgttcaatct

SEQ ID NO: 4645 - DNA, 43 bp, Artificial Sequence
  Synthetic
  misc_feature (21)..(22): n is a, c, g, or t
acaaaaatggcacctttaaannkggcgacatgttcaatctgaa

SEQ ID NO: 4646 - DNA, 43 bp, Artificial Sequence
  Synthetic
  misc_feature (21)..(22): n is a, c, g, or t
aaaatggcacctttaaaaagnnkgacatgttcaatctgaacga

SEQ ID NO: 4647 - DNA, 43 bp, Artificial Sequence
  Synthetic
  misc_feature (21)..(22): n is a, c, g, or t
atggcacctttaaaaagggcnnkatgttcaatctgaacgattg

SEQ ID NO: 4648 - DNA, 43 bp, Artificial Sequence
  Synthetic
  misc_feature (21)..(22): n is a, c, g, or t
gcacctttaaaaagggcgacnnkttcaatctgaacgattgcca

SEQ ID NO: 4649 - DNA, 43 bp, Artificial Sequence
  Synthetic
  misc_feature (21)..(22): n is a, c, g, or t
cctttaaaaagggcgacatgnnkaatctgaacgattgccacaa

SEQ ID NO: 4650 - DNA, 43 bp, Artificial Sequence
  Synthetic
  misc_feature (21)..(22): n is a, c, g, or t
ttaaaaagggcgacatgttcnnkctgaacgattgccacaaact

SEQ ID NO: 4651 - DNA, 43 bp, Artificial Sequence
  Synthetic
  misc_feature (21)..(22): n is a, c, g, or t
aaaagggcgacatgttcaatnnkaacgattgccacaaactgat

SEQ ID NO: 4652 - DNA, 43 bp, Artificial Sequence
  Synthetic
  misc_feature (21)..(22): n is a, c, g, or t
agggcgacatgttcaatctgnnkgattgccacaaactgatcga

SEQ ID NO: 4653 - DNA, 43 bp, Artificial Sequence
  Synthetic
  misc_feature (21)..(22): n is a, c, g, or t
gcgacatgttcaatctgaacnnktgccacaaactgatcgattt

SEQ ID NO: 4654 - DNA, 43 bp, Artificial Sequence
  Synthetic
  misc_feature (21)..(22): n is a, c, g, or t
acatgttcaatctgaacgatnnkcacaaactgatcgatttctt

SEQ ID NO: 4655 - DNA, 43 bp, Artificial Sequence
  Synthetic
  misc_feature (21)..(22): n is a, c, g, or t
tgttcaatctgaacgattgcnnkaaactgatcgatttcttcaa

SEQ ID NO: 4656 - DNA, 43 bp, Artificial Sequence
  Synthetic
  misc_feature (21)..(22): n is a, c, g, or t
tcaatctgaacgattgccacnnkctgatcgatttcttcaaaga

SEQ ID NO: 4657 - DNA, 43 bp, Artificial Sequence
  Synthetic
  misc_feature (21)..(22): n is a, c, g, or t
atctgaacgattgccacaaannkatcgatttcttcaaagattc

SEQ ID NO: 4658 - DNA, 43 bp, Artificial Sequence
  Synthetic
  misc_feature (21)..(22): n is a, c, g, or t
tgaacgattgccacaaactgnnkgatttcttcaaagattcaat

SEQ ID NO: 4659 - DNA, 43 bp, Artificial Sequence
  Synthetic
  misc_feature (21)..(22): n is a, c, g, or t
acgattgccacaaactgatcnnkttcttcaaagattcaatttc

SEQ ID NO: 4660 - DNA, 43 bp, Artificial Sequence
  Synthetic
  misc_feature (21)..(22): n is a, c, g, or t
attgccacaaactgatcgatnnkttcaaagattcaatttcgcg

SEQ ID NO: 4661 - DNA, 43 bp, Artificial Sequence
  Synthetic
  misc_feature (21)..(22): n is a, c, g, or t
gccacaaactgatcgatttcnnkaaagattcaatttcgcgtta

SEQ ID NO: 4662 - DNA, 43 bp, Artificial Sequence
  Synthetic
  misc_feature (21)..(22): n is a, c, g, or t
acaaactgatcgatttcttcnnkgattcaatttcgcgttatcc

SEQ ID NO: 4663 - DNA, 43 bp, Artificial Sequence
  Synthetic
  misc_feature (21)..(22): n is a, c, g, or t
aactgatcgatttcttcaaannktcaatttcgcgttatccgaa

SEQ ID NO: 4664 - DNA, 43 bp, Artificial Sequence
  Synthetic
  misc_feature (21)..(22): n is a, c, g, or t
tgatcgatttcttcaaagatnnkatttcgcgttatccgaaatg

SEQ ID NO: 4665 - DNA, 43 bp, Artificial Sequence
  Synthetic
  misc_feature (21)..(22): n is a, c, g, or t
tcgatttcttcaaagattcannktcgcgttatccgaaatggtc

SEQ ID NO: 4666 - DNA, 43 bp, Artificial Sequence
  Synthetic
  misc_feature (21)..(22): n is a, c, g, or t
atttcttcaaagattcaattnnkcgttatccgaaatggtccaa

SEQ ID NO: 4667 - DNA, 43 bp, Artificial Sequence
  Synthetic
  misc_feature (21)..(22): n is a, c, g, or t
tcttcaaagattcaatttcgnnktatccgaaatggtccaatgc

SEQ ID NO: 4668 - DNA, 43 bp, Artificial Sequence
  Synthetic
  misc_feature (21)..(22): n is a, c, g, or t
tcaaagattcaatttcgcgtnnkccgaaatggtccaatgccta

SEQ ID NO: 4669 - DNA, 43 bp, Artificial Sequence
  Synthetic
  misc_feature (21)..(22): n is a, c, g, or t
aagattcaatttcgcgttatnnkaaatggtccaatgcctatga

SEQ ID NO: 4670 - DNA, 43 bp, Artificial Sequence
  Synthetic
  misc_feature (21)..(22): n is a, c, g, or t
attcaatttcgcgttatccgnnktggtccaatgcctatgattt

SEQ ID NO: 4671 - DNA, 43 bp, Artificial Sequence
  Synthetic
  misc_feature (21)..(22): n is a, c, g, or t
caatttcgcgttatccgaaannktccaatgcctatgattttaa

SEQ ID NO: 4672 - DNA, 43 bp, Artificial Sequence
  Synthetic
  misc_feature (21)..(22): n is a, c, g, or t
tttcgcgttatccgaaatggnnkaatgcctatgattttaactt

SEQ ID NO: 4673 - DNA, 43 bp, Artificial Sequence
  Synthetic
  misc_feature (21)..(22): n is a, c, g, or t
cgcgttatccgaaatggtccnnkgcctatgattttaactttag

SEQ ID NO: 4674 - DNA, 43 bp, Artificial Sequence
  Synthetic
  misc_feature (21)..(22): n is a, c, g, or t
gttatccgaaatggtccaatnnktatgattttaactttagcga

SEQ ID NO: 4675 - DNA, 43 bp, Artificial Sequence
  Synthetic
  misc_feature (21)..(22): n is a, c, g, or t
atccgaaatggtccaatgccnnkgattttaactttagcgaaac

SEQ ID NO: 4676 - DNA, 43 bp, Artificial Sequence
  Synthetic
  misc_feature (21)..(22): n is a, c, g, or t
cgaaatggtccaatgcctatnnktttaactttagcgaaaccga

SEQ ID NO: 4677 - DNA, 43 bp, Artificial Sequence
  Synthetic
  misc_feature (21)..(22): n is a, c, g, or t
aatggtccaatgcctatgatnnkaactttagcgaaaccgaaaa

SEQ ID NO: 4678 - DNA, 43 bp, Artificial Sequence
  Synthetic
  misc_feature (21)..(22): n is a, c, g, or t
ggtccaatgcctatgattttnnktttagcgaaaccgaaaaata

SEQ ID NO: 4679 - DNA, 43 bp, Artificial Sequence
  Synthetic
  misc_feature (21)..(22): n is a, c, g, or t
ccaatgcctatgattttaacnnkagcgaaaccgaaaaatacaa

SEQ ID NO: 4680 - DNA, 43 bp, Artificial Sequence
  Synthetic
  misc_feature (21)..(22): n is a, c, g, or t
atgcctatgattttaactttnnkgaaaccgaaaaatacaaaga

SEQ ID NO: 4681 - DNA, 43 bp, Artificial Sequence
  Synthetic
  misc_feature (21)..(22): n is a, c, g, or t
cctatgattttaactttagcnnkaccgaaaaatacaaagacat

SEQ ID NO: 4682 - DNA, 43 bp, Artificial Sequence
  Synthetic
  misc_feature (21)..(22): n is a, c, g, or t
atgattttaactttagcgaannkgaaaaatacaaagacattgc

SEQ ID NO: 4683 - DNA, 43 bp, Artificial Sequence
  Synthetic
  misc_feature (21)..(22): n is a, c, g, or t
attttaactttagcgaaaccnnkaaatacaaagacattgccgg

SEQ ID NO: 4684 - DNA, 43 bp, Artificial Sequence
  Synthetic
  misc_feature (21)..(22): n is a, c, g, or t
ttaactttagcgaaaccgaannktacaaagacattgccggttt

SEQ ID NO: 4685 - DNA, 43 bp, Artificial Sequence
  Synthetic
  misc_feature (21)..(22): n is a, c, g, or t
actttagcgaaaccgaaaaannkaaagacattgccggttttta

SEQ ID NO: 4686 - DNA, 43 bp, Artificial Sequence
  Synthetic
  misc_feature (21)..(22): n is a, c, g, or t
ttagcgaaaccgaaaaatacnnkgacattgccggtttttatcg

SEQ ID NO: 4687 - DNA, 43 bp, Artificial Sequence
  Synthetic
  misc_feature (21)..(22): n is a, c, g, or t
gcgaaaccgaaaaatacaaannkattgccggtttttatcgcga

SEQ ID NO: 4688 - DNA, 43 bp, Artificial Sequence
  Synthetic
  misc_feature (21)..(22): n is a, c, g, or t
aaaccgaaaaatacaaagacnnkgccggtttttatcgcgaagt

SEQ ID NO: 4689 - DNA, 43 bp, Artificial Sequence
  Synthetic
  misc_feature (21)..(22): n is a, c, g, or t
ccgaaaaatacaaagacattnnkggtttttatcgcgaagtgga

SEQ ID NO: 4690 - DNA, 43 bp, Artificial Sequence
  Synthetic
  misc_feature (21)..(22): n is a, c, g, or t
aaaaatacaaagacattgccnnkttttatcgcgaagtggaaga

SEQ ID NO: 4691 - DNA, 43 bp, Artificial Sequence
  Synthetic
  misc_feature (21)..(22): n is a, c, g, or t
aatacaaagacattgccggtnnktatcgcgaagtggaagaaca

SEQ ID NO: 4692 - DNA, 43 bp, Artificial Sequence
  Synthetic
  misc_feature (21)..(22): n is a, c, g, or t
acaaagacattgccggttttnnkcgcgaagtggaagaacaggg

SEQ ID NO: 4693 - DNA, 43 bp, Artificial Sequence
  Synthetic
  misc_feature (21)..(22): n is a, c, g, or t
aagacattgccggtttttatnnkgaagtggaagaacagggcta

SEQ ID NO: 4694 - DNA, 43 bp, Artificial Sequence
  Synthetic
  misc_feature (21)..(22): n is a, c, g, or t
acattgccggtttttatcgcnnkgtggaagaacagggctataa

SEQ ID NO: 4695 - DNA, 43 bp, Artificial Sequence
  Synthetic
  misc_feature (21)..(22): n is a, c, g, or t
ttgccggtttttatcgcgaannkgaagaacagggctataaagt

SEQ ID NO: 4696 - DNA, 43 bp, Artificial Sequence
  Synthetic
  misc_feature (21)..(22): n is a, c, g, or t
ccggtttttatcgcgaagtgnnkgaacagggctataaagtgag

SEQ ID NO: 4697 - DNA, 43 bp, Artificial Sequence
  Synthetic
  misc_feature (21)..(22): n is a, c, g, or t
gtttttatcgcgaagtggaannkcagggctataaagtgagctt

SEQ ID NO: 4698 - DNA, 43 bp, Artificial Sequence
  Synthetic
  misc_feature (21)..(22): n is a, c, g, or t
tttatcgcgaagtggaagaannkggctataaagtgagctttga

SEQ ID NO: 4699 - DNA, 43 bp, Artificial Sequence
  Synthetic
  misc_feature (21)..(22): n is a, c, g, or t
atcgcgaagtggaagaacagnnktataaagtgagctttgaaag

SEQ ID NO: 4700 - DNA, 43 bp, Artificial Sequence
  Synthetic
  misc_feature (21)..(22): n is a, c, g, or t
gcgaagtggaagaacagggcnnkaaagtgagctttgaaagcgc

SEQ ID NO: 4701 - DNA, 43 bp, Artificial Sequence
  Synthetic
  misc_feature (21)..(22): n is a, c, g, or t
aagtggaagaacagggctatnnkgtgagctttgaaagcgcaag

SEQ ID NO: 4702 - DNA, 43 bp, Artificial Sequence
  Synthetic
  misc_feature (21)..(22): n is a, c, g, or t
tggaagaacagggctataaannkagctttgaaagcgcaagcaa

SEQ ID NO: 4703 - DNA, 43 bp, Artificial Sequence
  Synthetic
  misc_feature (21)..(22): n is a, c, g, or t
aagaacagggctataaagtgnnktttgaaagcgcaagcaaaaa

SEQ ID NO: 4704 - DNA, 43 bp, Artificial Sequence
  Synthetic
  misc_feature (21)..(22): n is a, c, g, or t
aacagggctataaagtgagcnnkgaaagcgcaagcaaaaaaga

SEQ ID NO: 4705 - DNA, 43 bp, Artificial Sequence
  Synthetic
  misc_feature (21)..(22): n is a, c, g, or t
agggctataaagtgagctttnnkagcgcaagcaaaaaagaggt

SEQ ID NO: 4706 - DNA, 43 bp, Artificial Sequence
  Synthetic
  misc_feature (21)..(22): n is a, c, g, or t
gctataaagtgagctttgaannkgcaagcaaaaaagaggttga

SEQ ID NO: 4707 - DNA, 43 bp, Artificial Sequence
  Synthetic
  misc_feature (21)..(22): n is a, c, g, or t
ataaagtgagctttgaaagcnnkagcaaaaaagaggttgataa

SEQ ID NO: 4708 - DNA, 43 bp, Artificial Sequence
  Synthetic
  misc_feature (21)..(22): n is a, c, g, or t
aagtgagctttgaaagcgcannkaaaaaagaggttgataagct

SEQ ID NO: 4709 - DNA, 43 bp, Artificial Sequence
  Synthetic
  misc_feature (21)..(22): n is a, c, g, or t
tgagctttgaaagcgcaagcnnkaaagaggttgataagctggt

SEQ ID NO: 4710 - DNA, 43 bp, Artificial Sequence
  Synthetic
  misc_feature (21)..(22): n is a, c, g, or t
gctttgaaagcgcaagcaaannkgaggttgataagctggttga

SEQ ID NO: 4711 - DNA, 43 bp, Artificial Sequence
  Synthetic
  misc_feature (21)..(22): n is a, c, g, or t
ttgaaagcgcaagcaaaaaannkgttgataagctggttgaaga

SEQ ID NO: 4712 - DNA, 43 bp, Artificial Sequence
  Synthetic
  misc_feature (21)..(22): n is a, c, g, or t
aaagcgcaagcaaaaaagagnnkgataagctggttgaagaggg

SEQ ID NO: 4713 - DNA, 43 bp, Artificial Sequence
  Synthetic
  misc_feature (21)..(22): n is a, c, g, or t
gcgcaagcaaaaaagaggttnnkaagctggttgaagagggcaa

SEQ ID NO: 4714 - DNA, 43 bp, Artificial Sequence
  Synthetic
  misc_feature (21)..(22): n is a, c, g, or t
caagcaaaaaagaggttgatnnkctggttgaagagggcaaact

SEQ ID NO: 4715 - DNA, 43 bp, Artificial Sequence
  Synthetic
  misc_feature (21)..(22): n is a, c, g, or t
gcaaaaaagaggttgataagnnkgttgaagagggcaaactgta

SEQ ID NO: 4716 - DNA, 43 bp, Artificial Sequence
  Synthetic
  misc_feature (21)..(22): n is a, c, g, or t
aaaaagaggttgataagctgnnkgaagagggcaaactgtatat

SEQ ID NO: 4717 - DNA, 43 bp, Artificial Sequence
  Synthetic
  misc_feature (21)..(22): n is a, c, g, or t
aagaggttgataagctggttnnkgagggcaaactgtatatgtt

SEQ ID NO: 4718 - DNA, 43 bp, Artificial Sequence
  Synthetic
  misc_feature (21)..(22): n is a, c, g, or t
aggttgataagctggttgaannkggcaaactgtatatgttcca

SEQ ID NO: 4719 - DNA, 43 bp, Artificial Sequence
  Synthetic
  misc_feature (21)..(22): n is a, c, g, or t
ttgataagctggttgaagagnnkaaactgtatatgttccagat

SEQ ID NO: 4720 - DNA, 43 bp, Artificial Sequence
  Synthetic
  misc_feature (21)..(22): n is a, c, g, or t
ataagctggttgaagagggcnnkctgtatatgttccagattta

SEQ ID NO: 4721 - DNA, 43 bp, Artificial Sequence
  Synthetic
  misc_feature (21)..(22): n is a, c, g, or t
agctggttgaagagggcaaannktatatgttccagatttacaa

SEQ ID NO: 4722 - DNA, 43 bp, Artificial Sequence
  Synthetic
  misc_feature (21)..(22): n is a, c, g, or t
tggttgaagagggcaaactgnnkatgttccagatttacaacaa

SEQ ID NO: 4723 - DNA, 43 bp, Artificial Sequence
  Synthetic
  misc_feature (21)..(22): n is a, c, g, or t
ttgaagagggcaaactgtatnnkttccagatttacaacaaaga

SEQ ID NO: 4724 - DNA, 43 bp, Artificial Sequence
  Synthetic
  misc_feature (21)..(22): n is a, c, g, or t
aagagggcaaactgtatatgnnkcagatttacaacaaagattt

SEQ ID NO: 4725 - DNA, 43 bp, Artificial Sequence
  Synthetic
  misc_feature (21)..(22): n is a, c, g, or t
agggcaaactgtatatgttcnnkatttacaacaaagattttag

SEQ ID NO: 4726 - DNA, 43 bp, Artificial Sequence
  Synthetic
  misc_feature (21)..(22): n is a, c, g, or t
gcaaactgtatatgttccagnnktacaacaaagattttagcga

SEQ ID NO: 4727 - DNA, 43 bp, Artificial Sequence
  Synthetic
  misc_feature (21)..(22): n is a, c, g, or t
aactgtatatgttccagattnnkaacaaagattttagcgacaa

SEQ ID NO: 4728 - DNA, 43 bp, Artificial Sequence
  Synthetic
  misc_feature (21)..(22): n is a, c, g, or t
tgtatatgttccagatttacnnkaaagattttagcgacaaaag

SEQ ID NO: 4729 - DNA, 43 bp, Artificial Sequence
  Synthetic
  misc_feature (21)..(22): n is a, c, g, or t
atatgttccagatttacaacnnkgattttagcgacaaaagcca

SEQ ID NO: 4730 - DNA, 43 bp, Artificial Sequence
  Synthetic
  misc_feature (21)..(22): n is a, c, g, or t
tgttccagatttacaacaaannktttagcgacaaaagccatgg

SEQ ID NO: 4731 - DNA, 43 bp, Artificial Sequence
  Synthetic
  misc_feature (21)..(22): n is a, c, g, or t
tccagatttacaacaaagatnnkagcgacaaaagccatggcac

SEQ ID NO: 4732 - DNA, 43 bp, Artificial Sequence
  Synthetic
  misc_feature (21)..(22): n is a, c, g, or t
agatttacaacaaagattttnnkgacaaaagccatggcacccc

SEQ ID NO: 4733 - DNA, 43 bp, Artificial Sequence
  Synthetic
  misc_feature (21)..(22): n is a, c, g, or t
tttacaacaaagattttagcnnkaaaagccatggcaccccgaa

SEQ ID NO: 4734 - DNA, 43 bp, Artificial Sequence
  Synthetic
  misc_feature (21)..(22): n is a, c, g, or t
acaacaaagattttagcgacnnkagccatggcaccccgaatct

SEQ ID NO: 4735 - DNA, 43 bp, Artificial Sequence
  Synthetic
  misc_feature (21)..(22): n is a, c, g, or t
acaaagattttagcgacaaannkcatggcaccccgaatctgca

SEQ ID NO: 4736 - DNA, 43 bp, Artificial Sequence
  Synthetic
  misc_feature (21)..(22): n is a, c, g, or t
aagattttagcgacaaaagcnnkggcaccccgaatctgcatac

SEQ ID NO: 4737 - DNA, 43 bp, Artificial Sequence
  Synthetic
  misc_feature (21)..(22): n is a, c, g, or t
attttagcgacaaaagccatnnkaccccgaatctgcataccat

SEQ ID NO: 4738 - DNA, 43 bp, Artificial Sequence
  Synthetic
  misc_feature (21)..(22): n is a, c, g, or t
ttagcgacaaaagccatggcnnkccgaatctgcataccatgta

SEQ ID NO: 4739 - DNA, 43 bp, Artificial Sequence
  Synthetic
  misc_feature (21)..(22): n is a, c, g, or t
gcgacaaaagccatggcaccnnkaatctgcataccatgtactt

SEQ ID NO: 4740 - DNA, 43 bp, Artificial Sequence
  Synthetic
  misc_feature (21)..(22): n is a, c, g, or t
acaaaagccatggcaccccgnnkctgcataccatgtactttaa

SEQ ID NO: 4741 - DNA, 43 bp, Artificial Sequence
  Synthetic
  misc_feature (21)..(22): n is a, c, g, or t
aaagccatggcaccccgaatnnkcataccatgtactttaaact

SEQ ID NO: 4742 - DNA, 43 bp, Artificial Sequence
  Synthetic
  misc_feature (21)..(22): n is a, c, g, or t
gccatggcaccccgaatctgnnkaccatgtactttaaactgct

SEQ ID NO: 4743 - DNA, 43 bp, Artificial Sequence
  Synthetic
  misc_feature (21)..(22): n is a, c, g, or t
atggcaccccgaatctgcatnnkatgtactttaaactgctgtt

SEQ ID NO: 4744 - DNA, 43 bp, Artificial Sequence
  Synthetic
  misc_feature (21)..(22): n is a, c, g, or t
gcaccccgaatctgcataccnnktactttaaactgctgttcga

SEQ ID NO: 4745 - DNA, 43 bp, Artificial Sequence
  Synthetic
  misc_feature (21)..(22): n is a, c, g, or t
ccccgaatctgcataccatgnnktttaaactgctgttcgacga

SEQ ID NO: 4746 - DNA, 43 bp, Artificial Sequence
  Synthetic
  misc_feature (21)..(22): n is a, c, g, or t
cgaatctgcataccatgtacnnkaaactgctgttcgacgaaaa

SEQ ID NO: 4747 - DNA, 43 bp, Artificial Sequence
  Synthetic
  misc_feature (21)..(22): n is a, c, g, or t
atctgcataccatgtactttnnkctgctgttcgacgaaaataa

SEQ ID NO: 4748 - DNA, 43 bp, Artificial Sequence
  Synthetic
  misc_feature (21)..(22): n is a, c, g, or t
tgcataccatgtactttaaannkctgttcgacgaaaataacca

SEQ ID NO: 4749 - DNA, 43 bp, Artificial Sequence
  Synthetic
  misc_feature (21)..(22): n is a, c, g, or t
ataccatgtactttaaactgnnkttcgacgaaaataaccatgg

SEQ ID NO: 4750 - DNA, 43 bp, Artificial Sequence
  Synthetic
  misc_feature (21)..(22): n is a, c, g, or t
ccatgtactttaaactgctgnnkgacgaaaataaccatggtca

SEQ ID NO: 4751 - DNA, 43 bp, Artificial Sequence
  Synthetic
  misc_feature (21)..(22): n is a, c, g, or t
tgtactttaaactgctgttcnnkgaaaataaccatggtcagat

SEQ ID NO: 4752 - DNA, 43 bp, Artificial Sequence
  Synthetic
  misc_feature (21)..(22): n is a, c, g, or t
actttaaactgctgttcgacnnkaataaccatggtcagattcg

SEQ ID NO: 4753 - DNA, 43 bp, Artificial Sequence
  Synthetic
  misc_feature (21)..(22): n is a, c, g, or t
ttaaactgctgttcgacgaannkaaccatggtcagattcgtct

SEQ ID NO: 4754 - DNA, 43 bp, Artificial Sequence
  Synthetic
  misc_feature (21)..(22): n is a, c, g, or t
aactgctgttcgacgaaaatnnkcatggtcagattcgtctgag

SEQ ID NO: 4755 - DNA, 43 bp, Artificial Sequence
  Synthetic
  misc_feature (21)..(22): n is a, c, g, or t
tgctgttcgacgaaaataacnnkggtcagattcgtctgagcgg

SEQ ID NO: 4756 - DNA, 43 bp, Artificial Sequence
  Synthetic
  misc_feature (21)..(22): n is a, c, g, or t
tgttcgacgaaaataaccatnnkcagattcgtctgagcggtgg

SEQ ID NO: 4757 - DNA, 43 bp, Artificial Sequence
  Synthetic
  misc_feature (21)..(22): n is a, c, g, or t
tcgacgaaaataaccatggtnnkattcgtctgagcggtggtgc

SEQ ID NO: 4758 - DNA, 43 bp, Artificial Sequence
  Synthetic
  misc_feature (21)..(22): n is a, c, g, or t
acgaaaataaccatggtcagnnkcgtctgagcggtggtgccga

SEQ ID NO: 4759 - DNA, 43 bp, Artificial Sequence
  Synthetic
  misc_feature (21)..(22): n is a, c, g, or t
aaaataaccatggtcagattnnkctgagcggtggtgccgaact

SEQ ID NO: 4760 - DNA, 43 bp, Artificial Sequence
  Synthetic
  misc_feature (21)..(22): n is a, c, g, or t
ataaccatggtcagattcgtnnkagcggtggtgccgaactgtt

SEQ ID NO: 4761 - DNA, 43 bp, Artificial Sequence
  Synthetic
  misc_feature (21)..(22): n is a, c, g, or t
accatggtcagattcgtctgnnkggtggtgccgaactgtttat

SEQ ID NO: 4762 - DNA, 43 bp, Artificial Sequence
  Synthetic
  misc_feature (21)..(22): n is a, c, g, or t
atggtcagattcgtctgagcnnkggtgccgaactgtttatgcg

SEQ ID NO: 4763 - DNA, 43 bp, Artificial Sequence
  Synthetic
  misc_feature (21)..(22): n is a, c, g, or t
gtcagattcgtctgagcggtnnkgccgaactgtttatgcgtcg

SEQ ID NO: 4764 - DNA, 43 bp, Artificial Sequence
  Synthetic
  misc_feature (21)..(22): n is a, c, g, or t
agattcgtctgagcggtggtnnkgaactgtttatgcgtcgtgc

SEQ ID NO: 4765 - DNA, 43 bp, Artificial Sequence
  Synthetic
  misc_feature (21)..(22): n is a, c, g, or t
ttcgtctgagcggtggtgccnnkctgtttatgcgtcgtgcaag

SEQ ID NO: 4766 - DNA, 43 bp, Artificial Sequence
  Synthetic
  misc_feature (21)..(22): n is a, c, g, or t
gtctgagcggtggtgccgaannktttatgcgtcgtgcaagtct

SEQ ID NO: 4767 - DNA, 43 bp, Artificial Sequence
  Synthetic
  misc_feature (21)..(22): n is a, c, g, or t
tgagcggtggtgccgaactgnnkatgcgtcgtgcaagtctgaa

SEQ ID NO: 4768 - DNA, 43 bp, Artificial Sequence
  Synthetic
  misc_feature (21)..(22): n is a, c, g, or t
gcggtggtgccgaactgtttnnkcgtcgtgcaagtctgaaaaa

SEQ ID NO: 4769 - DNA, 43 bp, Artificial Sequence
  Synthetic
  misc_feature (21)..(22): n is a, c, g, or t
gtggtgccgaactgtttatgnnkcgtgcaagtctgaaaaaaga

SEQ ID NO: 4770 - DNA, 43 bp, Artificial Sequence
  Synthetic
  misc_feature (21)..(22): n is a, c, g, or t
gtgccgaactgtttatgcgtnnkgcaagtctgaaaaaagaaga

SEQ ID NO: 4771 - DNA, 43 bp, Artificial Sequence
  Synthetic
  misc_feature (21)..(22): n is a, c, g, or t
ccgaactgtttatgcgtcgtnnkagtctgaaaaaagaagaact

SEQ ID NO: 4772 - DNA, 43 bp, Artificial Sequence
  Synthetic
  misc_feature (21)..(22): n is a, c, g, or t
aactgtttatgcgtcgtgcannkctgaaaaaagaagaactggt

SEQ ID NO: 4773 - DNA, 43 bp, Artificial Sequence
  Synthetic
  misc_feature (21)..(22): n is a, c, g, or t
tgtttatgcgtcgtgcaagtnnkaaaaaagaagaactggttgt

SEQ ID NO: 4774 - DNA, 43 bp, Artificial Sequence
  Synthetic
  misc_feature (21)..(22): n is a, c, g, or t
ttatgcgtcgtgcaagtctgnnkaaagaagaactggttgttca

SEQ ID NO: 4775 - DNA, 43 bp, Artificial Sequence
  Synthetic
  misc_feature (21)..(22): n is a, c, g, or t
tgcgtcgtgcaagtctgaaannkgaagaactggttgttcatcc

SEQ ID NO: 4776 - DNA, 43 bp, Artificial Sequence
  Synthetic
  misc_feature (21)..(22): n is a, c, g, or t
gtcgtgcaagtctgaaaaaannkgaactggttgttcatccggc

SEQ ID NO: 4777 - DNA, 43 bp, Artificial Sequence
  Synthetic
  misc_feature (21)..(22): n is a, c, g, or t
gtgcaagtctgaaaaaagaannkctggttgttcatccggcaaa

SEQ ID NO: 4778 - DNA, 43 bp, Artificial Sequence
  Synthetic
  misc_feature (21)..(22): n is a, c, g, or t
caagtctgaaaaaagaagaannkgttgttcatccggcaaatag

SEQ ID NO: 4779 - DNA, 43 bp, Artificial Sequence
  Synthetic
  misc_feature (21)..(22): n is a, c, g, or t
gtctgaaaaaagaagaactgnnkgttcatccggcaaatagccc

SEQ ID NO: 4780 - DNA, 43 bp, Artificial Sequence
  Synthetic
  misc_feature (21)..(22): n is a, c, g, or t
tgaaaaaagaagaactggttnnkcatccggcaaatagcccgat

SEQ ID NO: 4781 - DNA, 43 bp, Artificial Sequence
  Synthetic
  misc_feature (21)..(22): n is a, c, g, or t
aaaaagaagaactggttgttnnkccggcaaatagcccgattgc

SEQ ID NO: 4782 - DNA, 43 bp, Artificial Sequence
  Synthetic
  misc_feature (21)..(22): n is a, c, g, or t
aagaagaactggttgttcatnnkgcaaatagcccgattgcaaa

SEQ ID NO: 4783 - DNA, 43 bp, Artificial Sequence
  Synthetic
  misc_feature (21)..(22): n is a, c, g, or t
aagaactggttgttcatccgnnkaatagcccgattgcaaacaa

SEQ ID NO: 4784 - DNA, 43 bp, Artificial Sequence
  Synthetic
  misc_feature (21)..(22): n is a, c, g, or t
aactggttgttcatccggcannkagcccgattgcaaacaaaaa

SEQ ID NO: 4785 - DNA, 43 bp, Artificial Sequence
  Synthetic
  misc_feature (21)..(22): n is a, c, g, or t
tggttgttcatccggcaaatnnkccgattgcaaacaaaaatcc

SEQ ID NO: 4786 - DNA, 43 bp, Artificial Sequence
  Synthetic
  misc_feature (21)..(22): n is a, c, g, or t
ttgttcatccggcaaatagcnnkattgcaaacaaaaatccgga

SEQ ID NO: 4787 - DNA, 43 bp, Artificial Sequence
  Synthetic
  misc_feature (21)..(22): n is a, c, g, or t
ttcatccggcaaatagcccgnnkgcaaacaaaaatccggacaa

SEQ ID NO: 4788 - DNA, 43 bp, Artificial Sequence
  Synthetic
  misc_feature (21)..(22): n is a, c, g, or t
atccggcaaatagcccgattnnkaacaaaaatccggacaatcc

SEQ ID NO: 4789 - DNA, 43 bp, Artificial Sequence
  Synthetic
  misc_feature (21)..(22): n is a, c, g, or t
cggcaaatagcccgattgcannkaaaaatccggacaatccgaa

SEQ ID NO: 4790 - DNA, 43 bp, Artificial Sequence
  Synthetic
  misc_feature (21)..(22): n is a, c, g, or t
caaatagcccgattgcaaacnnkaatccggacaatccgaaaaa

SEQ ID NO: 4791 - DNA, 43 bp, Artificial Sequence
  Synthetic
  misc_feature (21)..(22): n is a, c, g, or t
atagcccgattgcaaacaaannkccggacaatccgaaaaaaac

SEQ ID NO: 4792 - DNA, 43 bp, Artificial Sequence
  Synthetic
  misc_feature (21)..(22): n is a, c, g, or t
gcccgattgcaaacaaaaatnnkgacaatccgaaaaaaaccac

SEQ ID NO: 4793 - DNA, 43 bp, Artificial Sequence
  Synthetic
  misc_feature (21)..(22): n is a, c, g, or t
cgattgcaaacaaaaatccgnnkaatccgaaaaaaaccacgac

SEQ ID NO: 4794 - DNA, 43 bp, Artificial Sequence
  Synthetic
  misc_feature (21)..(22): n is a, c, g, or t
ttgcaaacaaaaatccggacnnkccgaaaaaaaccacgacact

SEQ ID NO: 4795 - DNA, 43 bp, Artificial Sequence
  Synthetic
  misc_feature (21)..(22): n is a, c, g, or t
caaacaaaaatccggacaatnnkaaaaaaaccacgacactgag

SEQ ID NO: 4796 - DNA, 43 bp, Artificial Sequence
  Synthetic
  misc_feature (21)..(22): n is a, c, g, or t
acaaaaatccggacaatccgnnkaaaaccacgacactgagcta

SEQ ID NO: 4797 - DNA, 43 bp, Artificial Sequence
  Synthetic
  misc_feature (21)..(22): n is a, c, g, or t
aaaatccggacaatccgaaannkaccacgacactgagctatga

SEQ ID NO: 4798 - DNA, 43 bp, Artificial Sequence
  Synthetic
  misc_feature (21)..(22): n is a, c, g, or t
atccggacaatccgaaaaaannkacgacactgagctatgatgt

SEQ ID NO: 4799 - DNA, 43 bp, Artificial Sequence
  Synthetic
  misc_feature (21)..(22): n is a, c, g, or t
cggacaatccgaaaaaaaccnnkacactgagctatgatgtgta

SEQ ID NO: 4800 - DNA, 43 bp, Artificial Sequence
  Synthetic
  misc_feature (21)..(22): n is a, c, g, or t
acaatccgaaaaaaaccacgnnkctgagctatgatgtgtataa

SEQ ID NO: 4801 - DNA, 43 bp, Artificial Sequence
  Synthetic
  misc_feature (21)..(22): n is a, c, g, or t
atccgaaaaaaaccacgacannkagctatgatgtgtataaaga

SEQ ID NO: 4802 - DNA, 43 bp, Artificial Sequence
  Synthetic
  misc_feature (21)..(22): n is a, c, g, or t
cgaaaaaaaccacgacactgnnktatgatgtgtataaagacaa

SEQ ID NO: 4803 - DNA, 43 bp, Artificial Sequence
  Synthetic
  misc_feature (21)..(22): n is a, c, g, or t
aaaaaaccacgacactgagcnnkgatgtgtataaagacaaacg

SEQ ID NO: 4804 - DNA, 43 bp, Artificial Sequence
  Synthetic
  misc_feature (21)..(22): n is a, c, g, or t
aaaccacgacactgagctatnnkgtgtataaagacaaacgttt

SEQ ID NO: 4805 - DNA, 43 bp, Artificial Sequence
  Synthetic
  misc_feature (21)..(22): n is a, c, g, or t
ccacgacactgagctatgatnnktataaagacaaacgttttag

SEQ ID NO: 4806 - DNA, 43 bp, Artificial Sequence
  Synthetic
  misc_feature (21)..(22): n is a, c, g, or t
cgacactgagctatgatgtgnnkaaagacaaacgttttagcga

SEQ ID NO: 4807 - DNA, 43 bp, Artificial Sequence
  Synthetic
  misc_feature (21)..(22): n is a, c, g, or t
cactgagctatgatgtgtatnnkgacaaacgttttagcgagga

SEQ ID NO: 4808 - DNA, 43 bp, Artificial Sequence
  Synthetic
  misc_feature (21)..(22): n is a, c, g, or t
tgagctatgatgtgtataaannkaaacgttttagcgaggatca

SEQ ID NO: 4809 - DNA, 43 bp, Artificial Sequence
  Synthetic
  misc_feature (21)..(22): n is a, c, g, or t
gctatgatgtgtataaagacnnkcgttttagcgaggatcagta

SEQ ID NO: 4810 - DNA, 43 bp, Artificial Sequence
  Synthetic
  misc_feature (21)..(22): n is a, c, g, or t
atgatgtgtataaagacaaannktttagcgaggatcagtatga

SEQ ID NO: 4811 - DNA, 43 bp, Artificial Sequence
  Synthetic
  misc_feature (21)..(22): n is a, c, g, or t
atgtgtataaagacaaacgtnnkagcgaggatcagtatgaact

SEQ ID NO: 4812 - DNA, 43 bp, Artificial Sequence
  Synthetic
  misc_feature (21)..(22): n is a, c, g, or t
tgtataaagacaaacgttttnnkgaggatcagtatgaactgca

SEQ ID NO: 4813 - DNA, 43 bp, Artificial Sequence
  Synthetic
  misc_feature (21)..(22): n is a, c, g, or t
ataaagacaaacgttttagcnnkgatcagtatgaactgcatat

SEQ ID NO: 4814 - DNA, 43 bp, Artificial Sequence
  Synthetic
  misc_feature (21)..(22): n is a, c, g, or t
aagacaaacgttttagcgagnnkcagtatgaactgcatatccc

SEQ ID NO: 4815 - DNA, 43 bp, Artificial Sequence
  Synthetic
  misc_feature (21)..(22): n is a, c, g, or t
acaaacgttttagcgaggatnnktatgaactgcatatcccgat

SEQ ID NO: 4816 - DNA, 43 bp, Artificial Sequence
  Synthetic
  misc_feature (21)..(22): n is a, c, g, or t
aacgttttagcgaggatcagnnkgaactgcatatcccgattgc

SEQ ID NO: 4817 - DNA, 43 bp, Artificial Sequence
  Synthetic
  misc_feature (21)..(22): n is a, c, g, or t
gttttagcgaggatcagtatnnkctgcatatcccgattgccat

SEQ ID NO: 4818 - DNA, 43 bp, Artificial Sequence
  Synthetic
  misc_feature (21)..(22): n is a, c, g, or t
ttagcgaggatcagtatgaannkcatatcccgattgccatcaa

SEQ ID NO: 4819 - DNA, 43 bp, Artificial Sequence
  Synthetic
  misc_feature (21)..(22): n is a, c, g, or t
gcgaggatcagtatgaactgnnkatcccgattgccatcaataa

SEQ ID NO: 4820 - DNA, 43 bp, Artificial Sequence
  Synthetic
  misc_feature (21)..(22): n is a, c, g, or t
aggatcagtatgaactgcatnnkccgattgccatcaataaatg

SEQ ID NO: 4821 - DNA, 43 bp, Artificial Sequence
  Synthetic
  misc_feature (21)..(22): n is a, c, g, or t
atcagtatgaactgcatatcnnkattgccatcaataaatgccc

SEQ ID NO: 4822 - DNA, 43 bp, Artificial Sequence
  Synthetic
  misc_feature (21)..(22): n is a, c, g, or t
agtatgaactgcatatcccgnnkgccatcaataaatgcccgaa

SEQ ID NO: 4823 - DNA, 43 bp, Artificial Sequence
  Synthetic
  misc_feature (21)..(22): n is a, c, g, or t
atgaactgcatatcccgattnnkatcaataaatgcccgaaaaa

SEQ ID NO: 4824 - DNA, 43 bp, Artificial Sequence
  Synthetic
  misc_feature (21)..(22): n is a, c, g, or t
aactgcatatcccgattgccnnkaataaatgcccgaaaaacat

SEQ ID NO: 4825 - DNA, 43 bp, Artificial Sequence
  Synthetic
  misc_feature (21)..(22): n is a, c, g, or t
tgcatatcccgattgccatcnnkaaatgcccgaaaaacatctt

SEQ ID NO: 4826 - DNA, 43 bp, Artificial Sequence
  Synthetic
  misc_feature (21)..(22): n is a, c, g, or t
atatcccgattgccatcaatnnktgcccgaaaaacatctttaa

SEQ ID NO: 4827 - DNA, 43 bp, Artificial Sequence
  Synthetic
  misc_feature (21)..(22): n is a, c, g, or t
tcccgattgccatcaataaannkccgaaaaacatctttaagat

SEQ ID NO: 4828 - DNA, 43 bp, Artificial Sequence
  Synthetic
  misc_feature (21)..(22): n is a, c, g, or t
cgattgccatcaataaatgcnnkaaaaacatctttaagatcaa

SEQ ID NO: 4829 - DNA, 43 bp, Artificial Sequence
  Synthetic
  misc_feature (21)..(22): n is a, c, g, or t
ttgccatcaataaatgcccgnnkaacatctttaagatcaacac

SEQ ID NO: 4830 - DNA, 43 bp, Artificial Sequence
  Synthetic
  misc_feature (21)..(22): n is a, c, g, or t
ccatcaataaatgcccgaaannkatctttaagatcaacaccga

SEQ ID NO: 4831 - DNA, 43 bp, Artificial Sequence
  Synthetic
  misc_feature (21)..(22): n is a, c, g, or t
tcaataaatgcccgaaaaacnnktttaagatcaacaccgaagt

SEQ ID NO: 4832 - DNA, 43 bp, Artificial Sequence
  Synthetic
  misc_feature (21)..(22): n is a, c, g, or t
ataaatgcccgaaaaacatcnnkaagatcaacaccgaagttcg

SEQ ID NO: 4833 - DNA, 43 bp, Artificial Sequence
  Synthetic
  misc_feature (21)..(22): n is a, c, g, or t
aatgcccgaaaaacatctttnnkatcaacaccgaagttcgcgt

SEQ ID NO: 4834 - DNA, 43 bp, Artificial Sequence
  Synthetic
  misc_feature (21)..(22): n is a, c, g, or t
gcccgaaaaacatctttaagnnkaacaccgaagttcgcgtgct

SEQ ID NO: 4835 - DNA, 43 bp, Artificial Sequence
  Synthetic
  misc_feature (21)..(22): n is a, c, g, or t
cgaaaaacatctttaagatcnnkaccgaagttcgcgtgctgct

SEQ ID NO: 4836 - DNA, 43 bp, Artificial Sequence
  Synthetic
  misc_feature (21)..(22): n is a, c, g, or t
aaaacatctttaagatcaacnnkgaagttcgcgtgctgctgaa

SEQ ID NO: 4837 - DNA, 43 bp, Artificial Sequence
  Synthetic
  misc_feature (21)..(22): n is a, c, g, or t
acatctttaagatcaacaccnnkgttcgcgtgctgctgaaaca

SEQ ID NO: 4838 - DNA, 43 bp, Artificial Sequence
  Synthetic
  misc_feature (21)..(22): n is a, c, g, or t
tctttaagatcaacaccgaannkcgcgtgctgctgaaacatga

SEQ ID NO: 4839 - DNA, 43 bp, Artificial Sequence
  Synthetic
  misc_feature (21)..(22): n is a, c, g, or t
ttaagatcaacaccgaagttnnkgtgctgctgaaacatgatga

SEQ ID NO: 4840 - DNA, 43 bp, Artificial Sequence
  Synthetic
  misc_feature (21)..(22): n is a, c, g, or t
agatcaacaccgaagttcgcnnkctgctgaaacatgatgataa

SEQ ID NO: 4841 - DNA, 43 bp, Artificial Sequence
  Synthetic
  misc_feature (21)..(22): n is a, c, g, or t
tcaacaccgaagttcgcgtgnnkctgaaacatgatgataatcc

SEQ ID NO: 4842 - DNA, 43 bp, Artificial Sequence
  Synthetic
  misc_feature (21)..(22): n is a, c, g, or t
acaccgaagttcgcgtgctgnnkaaacatgatgataatccgta

SEQ ID NO: 4843 - DNA, 43 bp, Artificial Sequence
  Synthetic
  misc_feature (21)..(22): n is a, c, g, or t
ccgaagttcgcgtgctgctgnnkcatgatgataatccgtatgt

SEQ ID NO: 4844 - DNA, 43 bp, Artificial Sequence
  Synthetic
  misc_feature (21)..(22): n is a, c, g, or t
aagttcgcgtgctgctgaaannkgatgataatccgtatgtgat

SEQ ID NO: 4845 - DNA, 43 bp, Artificial Sequence
  Synthetic
  misc_feature (21)..(22): n is a, c, g, or t
ttcgcgtgctgctgaaacatnnkgataatccgtatgtgattgg

SEQ ID NO: 4846 - DNA, 43 bp, Artificial Sequence
  Synthetic
  misc_feature (21)..(22): n is a, c, g, or t
gcgtgctgctgaaacatgatnnkaatccgtatgtgattggcat

SEQ ID NO: 4847 - DNA, 43 bp, Artificial Sequence
  Synthetic
  misc_feature (21)..(22): n is a, c, g, or t
tgctgctgaaacatgatgatnnkccgtatgtgattggcattga

SEQ ID NO: 4848 - DNA, 43 bp, Artificial Sequence
  Synthetic
  misc_feature (21)..(22): n is a, c, g, or t
tgctgaaacatgatgataatnnktatgtgattggcattgatcg

SEQ ID NO: 4849 - DNA, 43 bp, Artificial Sequence
  Synthetic
  misc_feature (21)..(22): n is a, c, g, or t
tgaaacatgatgataatccgnnkgtgattggcattgatcgtgg

SEQ ID NO: 4850 - DNA, 43 bp, Artificial Sequence
  Synthetic
  misc_feature (21)..(22): n is a, c, g, or t
aacatgatgataatccgtatnnkattggcattgatcgtggtga

SEQ ID NO: 4851 - DNA, 43 bp, Artificial Sequence
  Synthetic
  misc_feature (21)..(22): n is a, c, g, or t
atgatgataatccgtatgtgnnkggcattgatcgtggtgaacg

SEQ ID NO: 4852 - DNA, 43 bp, Artificial Sequence
  Synthetic
  misc_feature (21)..(22): n is a, c, g, or t
atgataatccgtatgtgattnnkattgatcgtggtgaacgtaa

SEQ ID NO: 4853 - DNA, 43 bp, Artificial Sequence
  Synthetic
  misc_feature (21)..(22): n is a, c, g, or t
ataatccgtatgtgattggcnnkgatcgtggtgaacgtaacct

SEQ ID NO: 4854 - DNA, 43 bp, Artificial Sequence
  Synthetic
  misc_feature (21)..(22): n is a, c, g, or t
atccgtatgtgattggcattnnkcgtggtgaacgtaacctgct

SEQ ID NO: 4855 - DNA, 43 bp, Artificial Sequence
  Synthetic
  misc_feature (21)..(22): n is a, c, g, or t
cgtatgtgattggcattgatnnkggtgaacgtaacctgctgta

SEQ ID NO: 4856 - DNA, 43 bp, Artificial Sequence
  Synthetic
  misc_feature (21)..(22): n is a, c, g, or t
atgtgattggcattgatcgtnnkgaacgtaacctgctgtatat

SEQ ID NO: 4857 - DNA, 43 bp, Artificial Sequence
  Synthetic
  misc_feature (21)..(22): n is a, c, g, or t
tgattggcattgatcgtggtnnkcgtaacctgctgtatattgt

SEQ ID NO: 4858 - DNA, 43 bp, Artificial Sequence
  Synthetic
  misc_feature (21)..(22): n is a, c, g, or t
ttggcattgatcgtggtgaannkaacctgctgtatattgttgt

SEQ ID NO: 4859 - DNA, 43 bp, Artificial Sequence
  Synthetic
  misc_feature (21)..(22): n is a, c, g, or t
gcattgatcgtggtgaacgtnnkctgctgtatattgttgttgt

SEQ ID NO: 4860 - DNA, 43 bp, Artificial Sequence
  Synthetic
  misc_feature (21)..(22): n is a, c, g, or t
ttgatcgtggtgaacgtaacnnkctgtatattgttgttgttga

SEQ ID NO: 4861 - DNA, 43 bp, Artificial Sequence
  Synthetic
  misc_feature (21)..(22): n is a, c, g, or t
atcgtggtgaacgtaacctgnnktatattgttgttgttgatgg

SEQ ID NO: 4862 - DNA, 43 bp, Artificial Sequence
  Synthetic
  misc_feature (21)..(22): n is a, c, g, or t
gtggtgaacgtaacctgctgnnkattgttgttgttgatggtaa

SEQ ID NO: 4863 - DNA, 43 bp, Artificial Sequence
  Synthetic
  misc_feature (21)..(22): n is a, c, g, or t
gtgaacgtaacctgctgtatnnkgttgttgttgatggtaaagg

SEQ ID NO: 4864 - DNA, 43 bp, Artificial Sequence
  Synthetic
  misc_feature (21)..(22): n is a, c, g, or t
aacgtaacctgctgtatattnnkgttgttgatggtaaaggcaa

SEQ ID NO: 4865 - DNA, 43 bp, Artificial Sequence
  Synthetic
  misc_feature (21)..(22): n is a, c, g, or t
gtaacctgctgtatattgttnnkgttgatggtaaaggcaacat

SEQ ID NO: 4866 - DNA, 43 bp, Artificial Sequence
  Synthetic
  misc_feature (21)..(22): n is a, c, g, or t
acctgctgtatattgttgttnnkgatggtaaaggcaacatcgt

SEQ ID NO: 4867 - DNA, 43 bp, Artificial Sequence
  Synthetic
  misc_feature (21)..(22): n is a, c, g, or t
tgctgtatattgttgttgttnnkggtaaaggcaacatcgtgga

SEQ ID NO: 4868 - DNA, 43 bp, Artificial Sequence
  Synthetic
  misc_feature (21)..(22): n is a, c, g, or t
tgtatattgttgttgttgatnnkaaaggcaacatcgtggaaca

SEQ ID NO: 4869 - DNA, 43 bp, Artificial Sequence
  Synthetic
  misc_feature (21)..(22): n is a, c, g, or t
atattgttgttgttgatggtnnkggcaacatcgtggaacagta

SEQ ID NO: 4870 - DNA, 43 bp, Artificial Sequence
  Synthetic
  misc_feature (21)..(22): n is a, c, g, or t
ttgttgttgttgatggtaaannkaacatcgtggaacagtatag

SEQ ID NO: 4871 - DNA, 43 bp, Artificial Sequence
  Synthetic
  misc_feature (21)..(22): n is a, c, g, or t
ttgttgttgatggtaaaggcnnkatcgtggaacagtatagtct

SEQ ID NO: 4872 - DNA, 43 bp, Artificial Sequence
  Synthetic
  misc_feature (21)..(22): n is a, c, g, or t
ttgttgatggtaaaggcaacnnkgtggaacagtatagtctgaa

SEQ ID NO: 4873 - DNA, 43 bp, Artificial Sequence
  Synthetic
  misc_feature (21)..(22): n is a, c, g, or t
ttgatggtaaaggcaacatcnnkgaacagtatagtctgaacga

SEQ ID NO: 4874 - DNA, 43 bp, Artificial Sequence
  Synthetic
  misc_feature (21)..(22): n is a, c, g, or t
atggtaaaggcaacatcgtgnnkcagtatagtctgaacgaaat

SEQ ID NO: 4875 - DNA, 43 bp, Artificial Sequence
  Synthetic
  misc_feature (21)..(22): n is a, c, g, or t
gtaaaggcaacatcgtggaannktatagtctgaacgaaattat

SEQ ID NO: 4876 - DNA, 43 bp, Artificial Sequence
  Synthetic
  misc_feature (21)..(22): n is a, c, g, or t
aaggcaacatcgtggaacagnnkagtctgaacgaaattatcaa

SEQ ID NO: 4877 - DNA, 43 bp, Artificial Sequence
  Synthetic
  misc_feature (21)..(22): n is a, c, g, or t
gcaacatcgtggaacagtatnnkctgaacgaaattatcaacaa

SEQ ID NO: 4878 - DNA, 43 bp, Artificial Sequence
  Synthetic
  misc_feature (21)..(22): n is a, c, g, or t
acatcgtggaacagtatagtnnkaacgaaattatcaacaactt

SEQ ID NO: 4879 - DNA, 43 bp, Artificial Sequence
  Synthetic
  misc_feature (21)..(22): n is a, c, g, or t
tcgtggaacagtatagtctgnnkgaaattatcaacaactttaa

SEQ ID NO: 4880 - DNA, 43 bp, Artificial Sequence
  Synthetic
  misc_feature (21)..(22): n is a, c, g, or t
tggaacagtatagtctgaacnnkattatcaacaactttaacgg

SEQ ID NO: 4881 - DNA, 43 bp, Artificial Sequence
  Synthetic
  misc_feature (21)..(22): n is a, c, g, or t
aacagtatagtctgaacgaannkatcaacaactttaacggcat

SEQ ID NO: 4882 - DNA, 43 bp, Artificial Sequence
  Synthetic
  misc_feature (21)..(22): n is a, c, g, or t
agtatagtctgaacgaaattnnkaacaactttaacggcatccg

SEQ ID NO: 4883 - DNA, 43 bp, Artificial Sequence
  Synthetic
  misc_feature (21)..(22): n is a, c, g, or t
atagtctgaacgaaattatcnnkaactttaacggcatccgcat

SEQ ID NO: 4884 - DNA, 43 bp, Artificial Sequence
  Synthetic
  misc_feature (21)..(22): n is a, c, g, or t
gtctgaacgaaattatcaacnnktttaacggcatccgcatcaa

SEQ ID NO: 4885 - DNA, 43 bp, Artificial Sequence
  Synthetic
  misc_feature (21)..(22): n is a, c, g, or t
tgaacgaaattatcaacaacnnkaacggcatccgcatcaaaac

SEQ ID NO: 4886 - DNA, 43 bp, Artificial Sequence
  Synthetic
  misc_feature (21)..(22): n is a, c, g, or t
acgaaattatcaacaactttnnkggcatccgcatcaaaaccga

SEQ ID NO: 4887 - DNA, 43 bp, Artificial Sequence
  Synthetic
  misc_feature (21)..(22): n is a, c, g, or t
aaattatcaacaactttaacnnkatccgcatcaaaaccgacta

SEQ ID NO: 4888 - DNA, 43 bp, Artificial Sequence
  Synthetic
  misc_feature (21)..(22): n is a, c, g, or t
ttatcaacaactttaacggcnnkcgcatcaaaaccgactatca

SEQ ID NO: 4889 - DNA, 43 bp, Artificial Sequence
  Synthetic
  misc_feature (21)..(22): n is a, c, g, or t
tcaacaactttaacggcatcnnkatcaaaaccgactatcatag

SEQ ID NO: 4890 - DNA, 43 bp, Artificial Sequence
  Synthetic
  misc_feature (21)..(22): n is a, c, g, or t
acaactttaacggcatccgcnnkaaaaccgactatcatagcct

SEQ ID NO: 4891 - DNA, 43 bp, Artificial Sequence
  Synthetic
  misc_feature (21)..(22): n is a, c, g, or t
actttaacggcatccgcatcnnkaccgactatcatagcctgct

SEQ ID NO: 4892 - DNA, 43 bp, Artificial Sequence
  Synthetic
  misc_feature (21)..(22): n is a, c, g, or t
ttaacggcatccgcatcaaannkgactatcatagcctgctgga

SEQ ID NO: 4893 - DNA, 43 bp, Artificial Sequence
  Synthetic
  misc_feature (21)..(22): n is a, c, g, or t
acggcatccgcatcaaaaccnnktatcatagcctgctggacaa

SEQ ID NO: 4894 - DNA, 43 bp, Artificial Sequence
  Synthetic
  misc_feature (21)..(22): n is a, c, g, or t
gcatccgcatcaaaaccgacnnkcatagcctgctggacaagaa

SEQ ID NO: 4895 - DNA, 43 bp, Artificial Sequence
  Synthetic
  misc_feature (21)..(22): n is a, c, g, or t
tccgcatcaaaaccgactatnnkagcctgctggacaagaaaga

SEQ ID NO: 4896 - DNA, 43 bp, Artificial Sequence
  Synthetic
  misc_feature (21)..(22): n is a, c, g, or t
gcatcaaaaccgactatcatnnkctgctggacaagaaagaaaa

SEQ ID NO: 4897 - DNA, 43 bp, Artificial Sequence
  Synthetic
  misc_feature (21)..(22): n is a, c, g, or t
tcaaaaccgactatcatagcnnkctggacaagaaagaaaaaga

SEQ ID NO: 4898 - DNA, 43 bp, Artificial Sequence
  Synthetic
  misc_feature (21)..(22): n is a, c, g, or t
aaaccgactatcatagcctgnnkgacaagaaagaaaaagaacg

SEQ ID NO: 4899 - DNA, 43 bp, Artificial Sequence
  Synthetic
  misc_feature (21)..(22): n is a, c, g, or t
ccgactatcatagcctgctgnnkaagaaagaaaaagaacgttt

SEQ ID NO: 4900 - DNA, 43 bp, Artificial Sequence
  Synthetic
  misc_feature (21)..(22): n is a, c, g, or t
actatcatagcctgctggacnnkaaagaaaaagaacgttttga

SEQ ID NO: 4901 - DNA, 43 bp, Artificial Sequence
  Synthetic
  misc_feature (21)..(22): n is a, c, g, or t
atcatagcctgctggacaagnnkgaaaaagaacgttttgaagc

SEQ ID NO: 4902 - DNA, 43 bp, Artificial Sequence
  Synthetic
  misc_feature (21)..(22): n is a, c, g, or t
atagcctgctggacaagaaannkaaagaacgttttgaagcacg

SEQ ID NO: 4903 - DNA, 43 bp, Artificial Sequence
  Synthetic
  misc_feature (21)..(22): n is a, c, g, or t
gcctgctggacaagaaagaannkgaacgttttgaagcacgtca

SEQ ID NO: 4904 - DNA, 43 bp, Artificial Sequence
  Synthetic
  misc_feature (21)..(22): n is a, c, g, or t
tgctggacaagaaagaaaaannkcgttttgaagcacgtcagaa

SEQ ID NO: 4905 - DNA, 43 bp, Artificial Sequence
  Synthetic
  misc_feature (21)..(22): n is a, c, g, or t
tggacaagaaagaaaaagaannktttgaagcacgtcagaactg

SEQ ID NO: 4906 - DNA, 43 bp, Artificial Sequence
  Synthetic
  misc_feature (21)..(22): n is a, c, g, or t
acaagaaagaaaaagaacgtnnkgaagcacgtcagaactggac

SEQ ID NO: 4907 - DNA, 43 bp, Artificial Sequence
  Synthetic
  misc_feature (21)..(22): n is a, c, g, or t
agaaagaaaaagaacgttttnnkgcacgtcagaactggaccag

SEQ ID NO: 4908 - DNA, 43 bp, Artificial Sequence
  Synthetic
  misc_feature (21)..(22): n is a, c, g, or t
aagaaaaagaacgttttgaannkcgtcagaactggaccagtat

SEQ ID NO: 4909 - DNA, 43 bp, Artificial Sequence
  Synthetic
  misc_feature (21)..(22): n is a, c, g, or t
aaaaagaacgttttgaagcannkcagaactggaccagtattga

SEQ ID NO: 4910 - DNA, 43 bp, Artificial Sequence
  Synthetic
  misc_feature (21)..(22): n is a, c, g, or t
aagaacgttttgaagcacgtnnkaactggaccagtattgaaaa

SEQ ID NO: 4911 - DNA, 43 bp, Artificial Sequence
  Synthetic
  misc_feature (21)..(22): n is a, c, g, or t
aacgttttgaagcacgtcagnnktggaccagtattgaaaacat

SEQ ID NO: 4912 - DNA, 43 bp, Artificial Sequence
  Synthetic
  misc_feature (21)..(22): n is a, c, g, or t
gttttgaagcacgtcagaacnnkaccagtattgaaaacatcaa

SEQ ID NO: 4913 - DNA, 43 bp, Artificial Sequence
  Synthetic
  misc_feature (21)..(22): n is a, c, g, or t
ttgaagcacgtcagaactggnnkagtattgaaaacatcaaaga

SEQ ID NO: 4914 - DNA, 43 bp, Artificial Sequence
  Synthetic
  misc_feature (21)..(22): n is a, c, g, or t
aagcacgtcagaactggaccnnkattgaaaacatcaaagaact

SEQ ID NO: 4915 - DNA, 43 bp, Artificial Sequence
  Synthetic
  misc_feature (21)..(22): n is a, c, g, or t
cacgtcagaactggaccagtnnkgaaaacatcaaagaactgaa

SEQ ID NO: 4916 - DNA, 43 bp, Artificial Sequence
  Synthetic
  misc_feature (21)..(22): n is a, c, g, or t
gtcagaactggaccagtattnnkaacatcaaagaactgaaagc

SEQ ID NO: 4917 - DNA, 43 bp, Artificial Sequence
  Synthetic
  misc_feature (21)..(22): n is a, c, g, or t
agaactggaccagtattgaannkatcaaagaactgaaagccgg

SEQ ID NO: 4918 - DNA, 43 bp, Artificial Sequence
  Synthetic
  misc_feature (21)..(22): n is a, c, g, or t
actggaccagtattgaaaacnnkaaagaactgaaagccggtta

SEQ ID NO: 4919 - DNA, 43 bp, Artificial Sequence
  Synthetic
  misc_feature (21)..(22): n is a, c, g, or t
ggaccagtattgaaaacatcnnkgaactgaaagccggttatat

SEQ ID NO: 4920 - DNA, 43 bp, Artificial Sequence
  Synthetic
  misc_feature (21)..(22): n is a, c, g, or t
ccagtattgaaaacatcaaannkctgaaagccggttatattag

SEQ ID NO: 4921 - DNA, 43 bp, Artificial Sequence
  Synthetic
  misc_feature (21)..(22): n is a, c, g, or t
gtattgaaaacatcaaagaannkaaagccggttatattagcca

SEQ ID NO: 4922 - DNA, 43 bp, Artificial Sequence
  Synthetic
  misc_feature (21)..(22): n is a, c, g, or t
ttgaaaacatcaaagaactgnnkgccggttatattagccaggt

SEQ ID NO: 4923 - DNA, 43 bp, Artificial Sequence
  Synthetic
  misc_feature (21)..(22): n is a, c, g, or t
aaaacatcaaagaactgaaannkggttatattagccaggtggt

SEQ ID NO: 4924 - DNA, 43 bp, Artificial Sequence
  Synthetic
  misc_feature (21)..(22): n is a, c, g, or t
acatcaaagaactgaaagccnnktatattagccaggtggttca

SEQ ID NO: 4925 - DNA, 43 bp, Artificial Sequence
  Synthetic
  misc_feature (21)..(22): n is a, c, g, or t
tcaaagaactgaaagccggtnnkattagccaggtggttcataa

SEQ ID NO: 4926 - DNA, 43 bp, Artificial Sequence
  Synthetic
  misc_feature (21)..(22): n is a, c, g, or t
aagaactgaaagccggttatnnkagccaggtggttcataaaat

SEQ ID NO: 4927 - DNA, 43 bp, Artificial Sequence
  Synthetic
  misc_feature (21)..(22): n is a, c, g, or t
aactgaaagccggttatattnnkcaggtggttcataaaatctg

SEQ ID NO: 4928 - DNA, 43 bp, Artificial Sequence
  Synthetic
  misc_feature (21)..(22): n is a, c, g, or t
tgaaagccggttatattagcnnkgtggttcataaaatctgtga

SEQ ID NO: 4929 - DNA, 43 bp, Artificial Sequence
  Synthetic
  misc_feature (21)..(22): n is a, c, g, or t
aagccggttatattagccagnnkgttcataaaatctgtgagct

SEQ ID NO: 4930 - DNA, 43 bp, Artificial Sequence
  Synthetic
  misc_feature (21)..(22): n is a, c, g, or t
ccggttatattagccaggtgnnkcataaaatctgtgagctggt

SEQ ID NO: 4931 - DNA, 43 bp, Artificial Sequence
  Synthetic
  misc_feature (21)..(22): n is a, c, g, or t
gttatattagccaggtggttnnkaaaatctgtgagctggtaga

SEQ ID NO: 4932 - DNA, 43 bp, Artificial Sequence
  Synthetic
  misc_feature (21)..(22): n is a, c, g, or t
atattagccaggtggttcatnnkatctgtgagctggtagaaaa

SEQ ID NO: 4933 - DNA, 43 bp, Artificial Sequence
  Synthetic
  misc_feature (21)..(22): n is a, c, g, or t
ttagccaggtggttcataaannktgtgagctggtagaaaaata

SEQ ID NO: 4934 - DNA, 43 bp, Artificial Sequence
  Synthetic
  misc_feature (21)..(22): n is a, c, g, or t
gccaggtggttcataaaatcnnkgagctggtagaaaaatacga

SEQ ID NO: 4935 - DNA, 43 bp, Artificial Sequence
  Synthetic
  misc_feature (21)..(22): n is a, c, g, or t
aggtggttcataaaatctgtnnkctggtagaaaaatacgatgc

SEQ ID NO: 4936 - DNA, 43 bp, Artificial Sequence
  Synthetic
  misc_feature (21)..(22): n is a, c, g, or t
tggttcataaaatctgtgagnnkgtagaaaaatacgatgcagt

SEQ ID NO: 4937 - DNA, 43 bp, Artificial Sequence
  Synthetic
  misc_feature (21)..(22): n is a, c, g, or t
ttcataaaatctgtgagctgnnkgaaaaatacgatgcagttat

SEQ ID NO: 4938 - DNA, 43 bp, Artificial Sequence
  Synthetic
  misc_feature (21)..(22): n is a, c, g, or t
ataaaatctgtgagctggtannkaaatacgatgcagttattgc

SEQ ID NO: 4939 - DNA, 43 bp, Artificial Sequence
  Synthetic
  misc_feature (21)..(22): n is a, c, g, or t
aaatctgtgagctggtagaannktacgatgcagttattgcact

SEQ ID NO: 4940 - DNA, 43 bp, Artificial Sequence
  Synthetic
  misc_feature (21)..(22): n is a, c, g, or t
tctgtgagctggtagaaaaannkgatgcagttattgcactgga

SEQ ID NO: 4941 - DNA, 43 bp, Artificial Sequence
  Synthetic
  misc_feature (21)..(22): n is a, c, g, or t
gtgagctggtagaaaaatacnnkgcagttattgcactggaaga

SEQ ID NO: 4942 - DNA, 43 bp, Artificial Sequence
  Synthetic
  misc_feature (21)..(22): n is a, c, g, or t
agctggtagaaaaatacgatnnkgttattgcactggaagatct

SEQ ID NO: 4943 - DNA, 43 bp, Artificial Sequence
  Synthetic
  misc_feature (21)..(22): n is a, c, g, or t
tggtagaaaaatacgatgcannkattgcactggaagatctgaa

SEQ ID NO: 4944 - DNA, 43 bp, Artificial Sequence
  Synthetic
  misc_feature (21)..(22): n is a, c, g, or t
tagaaaaatacgatgcagttnnkgcactggaagatctgaatag

SEQ ID NO: 4945 - DNA, 43 bp, Artificial Sequence
  Synthetic
  misc_feature (21)..(22): n is a, c, g, or t
aaaaatacgatgcagttattnnkctggaagatctgaatagcgg

SEQ ID NO: 4946 - DNA, 43 bp, Artificial Sequence
  Synthetic
  misc_feature (21)..(22): n is a, c, g, or t
aatacgatgcagttattgcannkgaagatctgaatagcggttt

SEQ ID NO: 4947 - DNA, 43 bp, Artificial Sequence
  Synthetic
  misc_feature (21)..(22): n is a, c, g, or t
acgatgcagttattgcactgnnkgatctgaatagcggtttcaa

SEQ ID NO: 4948 - DNA, 43 bp, Artificial Sequence
  Synthetic
  misc_feature (21)..(22): n is a, c, g, or t
atgcagttattgcactggaannkctgaatagcggtttcaaaaa

SEQ ID NO: 4949 - DNA, 43 bp, Artificial Sequence
  Synthetic
  misc_feature (21)..(22): n is a, c, g, or t
cagttattgcactggaagatnnkaatagcggtttcaaaaatag

SEQ ID NO: 4950 - DNA, 43 bp, Artificial Sequence
  Synthetic
  misc_feature (21)..(22): n is a, c, g, or t
ttattgcactggaagatctgnnkagcggtttcaaaaatagccg

SEQ ID NO: 4951 - DNA, 43 bp, Artificial Sequence
  Synthetic
  misc_feature (21)..(22): n is a, c, g, or t
ttgcactggaagatctgaatnnkggtttcaaaaatagccgtgt

SEQ ID NO: 4952 - DNA, 43 bp, Artificial Sequence
  Synthetic
  misc_feature (21)..(22): n is a, c, g, or t
cactggaagatctgaatagcnnkttcaaaaatagccgtgtgaa

SEQ ID NO: 4953 - DNA, 43 bp, Artificial Sequence
  Synthetic
  misc_feature (21)..(22): n is a, c, g, or t
tggaagatctgaatagcggtnnkaaaaatagccgtgtgaaagt

SEQ ID NO: 4954 - DNA, 43 bp, Artificial Sequence
  Synthetic
  misc_feature (21)..(22): n is a, c, g, or t
aagatctgaatagcggtttcnnkaatagccgtgtgaaagtcga

SEQ ID NO: 4955 - DNA, 43 bp, Artificial Sequence
  Synthetic
  misc_feature (21)..(22): n is a, c, g, or t
atctgaatagcggtttcaaannkagccgtgtgaaagtcgaaaa

SEQ ID NO: 4956 - DNA, 43 bp, Artificial Sequence
  Synthetic
  misc_feature (21)..(22): n is a, c, g, or t
tgaatagcggtttcaaaaatnnkcgtgtgaaagtcgaaaaaca

SEQ ID NO: 4957 - DNA, 43 bp, Artificial Sequence
  Synthetic
  misc_feature (21)..(22): n is a, c, g, or t
atagcggtttcaaaaatagcnnkgtgaaagtcgaaaaacaggt

SEQ ID NO: 4958 - DNA, 43 bp, Artificial Sequence
  Synthetic
  misc_feature (21)..(22): n is a, c, g, or t
gcggtttcaaaaatagccgtnnkaaagtcgaaaaacaggtgta

SEQ ID NO: 4959 - DNA, 43 bp, Artificial Sequence
  Synthetic
  misc_feature (21)..(22): n is a, c, g, or t
gtttcaaaaatagccgtgtgnnkgtcgaaaaacaggtgtatca

SEQ ID NO: 4960 - DNA, 43 bp, Artificial Sequence
  Synthetic
  misc_feature (21)..(22): n is a, c, g, or t
tcaaaaatagccgtgtgaaannkgaaaaacaggtgtatcagaa

SEQ ID NO: 4961 - DNA, 43 bp, Artificial Sequence
  Synthetic
  misc_feature (21)..(22): n is a, c, g, or t
aaaatagccgtgtgaaagtcnnkaaacaggtgtatcagaaatt

SEQ ID NO: 4962 - DNA, 43 bp, Artificial Sequence
  Synthetic
  misc_feature (21)..(22): n is a, c, g, or t
atagccgtgtgaaagtcgaannkcaggtgtatcagaaattcga

SEQ ID NO: 4963 - DNA, 43 bp, Artificial Sequence
  Synthetic
  misc_feature (21)..(22): n is a, c, g, or t
gccgtgtgaaagtcgaaaaannkgtgtatcagaaattcgagaa

SEQ ID NO: 4964 - DNA, 43 bp, Artificial Sequence
  Synthetic
  misc_feature (21)..(22): n is a, c, g, or t
gtgtgaaagtcgaaaaacagnnktatcagaaattcgagaaaat

SEQ ID NO: 4965 - DNA, 43 bp, Artificial Sequence
  Synthetic
  misc_feature (21)..(22): n is a, c, g, or t
tgaaagtcgaaaaacaggtgnnkcagaaattcgagaaaatgct

SEQ ID NO: 4966 - DNA, 43 bp, Artificial Sequence
  Synthetic
  misc_feature (21)..(22): n is a, c, g, or t
aagtcgaaaaacaggtgtatnnkaaattcgagaaaatgctgat

SEQ ID NO: 4967 - DNA, 43 bp, Artificial Sequence
  Synthetic
  misc_feature (21)..(22): n is a, c, g, or t
tcgaaaaacaggtgtatcagnnkttcgagaaaatgctgatcga

SEQ ID NO: 4968 - DNA, 43 bp, Artificial Sequence
  Synthetic
  misc_feature (21)..(22): n is a, c, g, or t
aaaaacaggtgtatcagaaannkgagaaaatgctgatcgacaa

SEQ ID NO: 4969 - DNA, 43 bp, Artificial Sequence
  Synthetic
  misc_feature (21)..(22): n is a, c, g, or t
aacaggtgtatcagaaattcnnkaaaatgctgatcgacaaact

SEQ ID NO: 4970 - DNA, 43 bp, Artificial Sequence
  Synthetic
  misc_feature (21)..(22): n is a, c, g, or t
aggtgtatcagaaattcgagnnkatgctgatcgacaaactgaa

SEQ ID NO: 4971 - DNA, 43 bp, Artificial Sequence
  Synthetic
  misc_feature (21)..(22): n is a, c, g, or t
tgtatcagaaattcgagaaannkctgatcgacaaactgaacta

SEQ ID NO: 4972 - DNA, 43 bp, Artificial Sequence
  Synthetic
  misc_feature (21)..(22): n is a, c, g, or t
atcagaaattcgagaaaatgnnkatcgacaaactgaactacat

SEQ ID NO: 4973 - DNA, 43 bp, Artificial Sequence
  Synthetic
  misc_feature (21)..(22): n is a, c, g, or t
agaaattcgagaaaatgctgnnkgacaaactgaactacatggt

SEQ ID NO: 4974 - DNA, 43 bp, Artificial Sequence
  Synthetic
  misc_feature (21)..(22): n is a, c, g, or t
aattcgagaaaatgctgatcnnkaaactgaactacatggtcga

SEQ ID NO: 4975 - DNA, 43 bp, Artificial Sequence
  Synthetic
  misc_feature (21)..(22): n is a, c, g, or t
tcgagaaaatgctgatcgacnnkctgaactacatggtcgacaa

SEQ ID NO: 4976 - DNA, 43 bp, Artificial Sequence
  Synthetic
  misc_feature (21)..(22): n is a, c, g, or t
agaaaatgctgatcgacaaannkaactacatggtcgacaaaaa

SEQ ID NO: 4977 - DNA, 43 bp, Artificial Sequence
  Synthetic
  misc_feature (21)..(22): n is a, c, g, or t
aaatgctgatcgacaaactgnnktacatggtcgacaaaaaaag

SEQ ID NO: 4978 - DNA, 43 bp, Artificial Sequence
  Synthetic
  misc_feature (21)..(22): n is a, c, g, or t
tgctgatcgacaaactgaacnnkatggtcgacaaaaaaagcaa

SEQ ID NO: 4979 - DNA, 43 bp, Artificial Sequence
  Synthetic
  misc_feature (21)..(22): n is a, c, g, or t
tgatcgacaaactgaactacnnkgtcgacaaaaaaagcaatcc

SEQ ID NO: 4980 - DNA, 43 bp, Artificial Sequence
  Synthetic
  misc_feature (21)..(22): n is a, c, g, or t
tcgacaaactgaactacatgnnkgacaaaaaaagcaatccgtg

SEQ ID NO: 4981 - DNA, 43 bp, Artificial Sequence
  Synthetic
  misc_feature (21)..(22): n is a, c, g, or t
acaaactgaactacatggtcnnkaaaaaaagcaatccgtgtgc

SEQ ID NO: 4982 - DNA, 43 bp, Artificial Sequence
  Synthetic
  misc_feature (21)..(22): n is a, c, g, or t
aactgaactacatggtcgacnnkaaaagcaatccgtgtgcaac

SEQ ID NO: 4983 - DNA, 43 bp, Artificial Sequence
  Synthetic
  misc_feature (21)..(22): n is a, c, g, or t
tgaactacatggtcgacaaannkagcaatccgtgtgcaaccgg

SEQ ID NO: 4984 - DNA, 43 bp, Artificial Sequence
  Synthetic
  misc_feature (21)..(22): n is a, c, g, or t
actacatggtcgacaaaaaannkaatccgtgtgcaaccggtgg

SEQ ID NO: 4985 - DNA, 43 bp, Artificial Sequence
  Synthetic
  misc_feature (21)..(22): n is a, c, g, or t
acatggtcgacaaaaaaagcnnkccgtgtgcaaccggtggtgc

SEQ ID NO: 4986 - DNA, 43 bp, Artificial Sequence
  Synthetic
  misc_feature (21)..(22): n is a, c, g, or t
tggtcgacaaaaaaagcaatnnktgtgcaaccggtggtgcact

SEQ ID NO: 4987 - DNA, 43 bp, Artificial Sequence
  Synthetic
  misc_feature (21)..(22): n is a, c, g, or t
tcgacaaaaaaagcaatccgnnkgcaaccggtggtgcactgaa

SEQ ID NO: 4988 - DNA, 43 bp, Artificial Sequence
  Synthetic
  misc_feature (21)..(22): n is a, c, g, or t
acaaaaaaagcaatccgtgtnnkaccggtggtgcactgaaagg

SEQ ID NO: 4989 - DNA, 43 bp, Artificial Sequence
  Synthetic
  misc_feature (21)..(22): n is a, c, g, or t
aaaaaagcaatccgtgtgcannkggtggtgcactgaaaggtta

SEQ ID NO: 4990 - DNA, 43 bp, Artificial Sequence
  Synthetic
  misc_feature (21)..(22): n is a, c, g, or t
aaagcaatccgtgtgcaaccnnkggtgcactgaaaggttatca

SEQ ID NO: 4991 - DNA, 43 bp, Artificial Sequence
  Synthetic
  misc_feature (21)..(22): n is a, c, g, or t
gcaatccgtgtgcaaccggtnnkgcactgaaaggttatcagat

SEQ ID NO: 4992 - DNA, 43 bp, Artificial Sequence
  Synthetic
  misc_feature (21)..(22): n is a, c, g, or t
atccgtgtgcaaccggtggtnnkctgaaaggttatcagattac

SEQ ID NO: 4993 - DNA, 43 bp, Artificial Sequence
  Synthetic
  misc_feature (21)..(22): n is a, c, g, or t
cgtgtgcaaccggtggtgcannkaaaggttatcagattaccaa

SEQ ID NO: 4994 - DNA, 43 bp, Artificial Sequence
  Synthetic
  misc_feature (21)..(22): n is a, c, g, or t
gtgcaaccggtggtgcactgnnkggttatcagattaccaacaa

SEQ ID NO: 4995 - DNA, 43 bp, Artificial Sequence
  Synthetic
  misc_feature (21)..(22): n is a, c, g, or t
caaccggtggtgcactgaaannktatcagattaccaacaaatt

SEQ ID NO: 4996 - DNA, 43 bp, Artificial Sequence
  Synthetic
  misc_feature (21)..(22): n is a, c, g, or t
ccggtggtgcactgaaaggtnnkcagattaccaacaaatttga

SEQ ID NO: 4997 - DNA, 43 bp, Artificial Sequence
  Synthetic
  misc_feature (21)..(22): n is a, c, g, or t
gtggtgcactgaaaggttatnnkattaccaacaaatttgaaag

SEQ ID NO: 4998 - DNA, 43 bp, Artificial Sequence
  Synthetic
  misc_feature (21)..(22): n is a, c, g, or t
gtgcactgaaaggttatcagnnkaccaacaaatttgaaagctt

SEQ ID NO: 4999 - DNA, 43 bp, Artificial Sequence
  Synthetic
  misc_feature (21)..(22): n is a, c, g, or t
cactgaaaggttatcagattnnkaacaaatttgaaagctttaa

SEQ ID NO: 5000 - DNA, 43 bp, Artificial Sequence
  Synthetic
  misc_feature (21)..(22): n is a, c, g, or t
tgaaaggttatcagattaccnnkaaatttgaaagctttaaaag

SEQ ID NO: 5001 - DNA, 43 bp, Artificial Sequence
  Synthetic
  misc_feature (21)..(22): n is a, c, g, or t
aaggttatcagattaccaacnnktttgaaagctttaaaagcat

SEQ ID NO: 5002 - DNA, 43 bp, Artificial Sequence
  Synthetic
  misc_feature (21)..(22): n is a, c, g, or t
gttatcagattaccaacaaannkgaaagctttaaaagcatgag

SEQ ID NO: 5003 - DNA, 43 bp, Artificial Sequence
  Synthetic
  misc_feature (21)..(22): n is a, c, g, or t
atcagattaccaacaaatttnnkagctttaaaagcatgagcac

SEQ ID NO: 5004 - DNA, 43 bp, Artificial Sequence
  Synthetic
  misc_feature (21)..(22): n is a, c, g, or t
agattaccaacaaatttgaannktttaaaagcatgagcaccca

SEQ ID NO: 5005 - DNA, 43 bp, Artificial Sequence
  Synthetic
  misc_feature (21)..(22): n is a, c, g, or t
ttaccaacaaatttgaaagcnnkaaaagcatgagcacccagaa

SEQ ID NO: 5006 - DNA, 43 bp, Artificial Sequence
  Synthetic
  misc_feature (21)..(22): n is a, c, g, or t
ccaacaaatttgaaagctttnnkagcatgagcacccagaacgg

SEQ ID NO: 5007 - DNA, 43 bp, Artificial Sequence
  Synthetic
  misc_feature (21)..(22): n is a, c, g, or t
acaaatttgaaagctttaaannkatgagcacccagaacggctt

SEQ ID NO: 5008 - DNA, 43 bp, Artificial Sequence
  Synthetic
  misc_feature (21)..(22): n is a, c, g, or t
aatttgaaagctttaaaagcnnkagcacccagaacggctttat

SEQ ID NO: 5009 - DNA, 43 bp, Artificial Sequence
  Synthetic
  misc_feature (21)..(22): n is a, c, g, or t
ttgaaagctttaaaagcatgnnkacccagaacggctttatctt

SEQ ID NO: 5010 - DNA, 43 bp, Artificial Sequence
  Synthetic
  misc_feature (21)..(22): n is a, c, g, or t
aaagctttaaaagcatgagcnnkcagaacggctttatcttcta

SEQ ID NO: 5011 - DNA, 43 bp, Artificial Sequence
  Synthetic
  misc_feature (21)..(22): n is a, c, g, or t
gctttaaaagcatgagcaccnnkaacggctttatcttctatat

SEQ ID NO: 5012 - DNA, 43 bp, Artificial Sequence
  Synthetic
  misc_feature (21)..(22): n is a, c, g, or t
ttaaaagcatgagcacccagnnkggctttatcttctatattcc

SEQ ID NO: 5013 - DNA, 43 bp, Artificial Sequence
  Synthetic
  misc_feature (21)..(22): n is a, c, g, or t
aaagcatgagcacccagaacnnktttatcttctatattccggc

SEQ ID NO: 5014 - DNA, 43 bp, Artificial Sequence
  Synthetic
  misc_feature (21)..(22): n is a, c, g, or t
gcatgagcacccagaacggcnnkatcttctatattccggcatg

SEQ ID NO: 5015 - DNA, 43 bp, Artificial Sequence
  Synthetic
  misc_feature (21)..(22): n is a, c, g, or t
tgagcacccagaacggctttnnkttctatattccggcatggct

SEQ ID NO: 5016 - DNA, 43 bp, Artificial Sequence
  Synthetic
  misc_feature (21)..(22): n is a, c, g, or t
gcacccagaacggctttatcnnktatattccggcatggctgac

SEQ ID NO: 5017 - DNA, 43 bp, Artificial Sequence
  Synthetic
  misc_feature (21)..(22): n is a, c, g, or t
cccagaacggctttatcttcnnkattccggcatggctgaccag

SEQ ID NO: 5018 - DNA, 43 bp, Artificial Sequence
  Synthetic
  misc_feature (21)..(22): n is a, c, g, or t
agaacggctttatcttctatnnkccggcatggctgaccagcaa

SEQ ID NO: 5019 - DNA, 43 bp, Artificial Sequence
  Synthetic
  misc_feature (21)..(22): n is a, c, g, or t
acggctttatcttctatattnnkgcatggctgaccagcaaaat

SEQ ID NO: 5020 - DNA, 43 bp, Artificial Sequence
  Synthetic
  misc_feature (21)..(22): n is a, c, g, or t
gctttatcttctatattccgnnktggctgaccagcaaaattga

SEQ ID NO: 5021 - DNA, 43 bp, Artificial Sequence
  Synthetic
  misc_feature (21)..(22): n is a, c, g, or t
ttatcttctatattccggcannkctgaccagcaaaattgatcc

SEQ ID NO: 5022 - DNA, 43 bp, Artificial Sequence
  Synthetic
  misc_feature (21)..(22): n is a, c, g, or t
tcttctatattccggcatggnnkaccagcaaaattgatccgag

SEQ ID NO: 5023 - DNA, 43 bp, Artificial Sequence
  Synthetic
  misc_feature (21)..(22): n is a, c, g, or t
tctatattccggcatggctgnnkagcaaaattgatccgagcac

SEQ ID NO: 5024 - DNA, 43 bp, Artificial Sequence
  Synthetic
  misc_feature (21)..(22): n is a, c, g, or t
atattccggcatggctgaccnnkaaaattgatccgagcaccgg

SEQ ID NO: 5025 - DNA, 43 bp, Artificial Sequence
  Synthetic
  misc_feature (21)..(22): n is a, c, g, or t
ttccggcatggctgaccagcnnkattgatccgagcaccggttt

SEQ ID NO: 5026 - DNA, 43 bp, Artificial Sequence
  Synthetic
  misc_feature (21)..(22): n is a, c, g, or t
cggcatggctgaccagcaaannkgatccgagcaccggttttgt

SEQ ID NO: 5027 - DNA, 43 bp, Artificial Sequence
  Synthetic
  misc_feature (21)..(22): n is a, c, g, or t
catggctgaccagcaaaattnnkccgagcaccggttttgtgaa

SEQ ID NO: 5028 - DNA, 43 bp, Artificial Sequence
  Synthetic
  misc_feature (21)..(22): n is a, c, g, or t
ggctgaccagcaaaattgatnnkagcaccggttttgtgaacct

SEQ ID NO: 5029 - DNA, 43 bp, Artificial Sequence
  Synthetic
  misc_feature (21)..(22): n is a, c, g, or t
tgaccagcaaaattgatccgnnkaccggttttgtgaacctgct

SEQ ID NO: 5030 - DNA, 43 bp, Artificial Sequence
  Synthetic
  misc_feature (21)..(22): n is a, c, g, or t
ccagcaaaattgatccgagcnnkggttttgtgaacctgctgaa

SEQ ID NO: 5031 - DNA, 43 bp, Artificial Sequence
  Synthetic
  misc_feature (21)..(22): n is a, c, g, or t
gcaaaattgatccgagcaccnnktttgtgaacctgctgaaaac

SEQ ID NO: 5032 - DNA, 43 bp, Artificial Sequence
  Synthetic
  misc_feature (21)..(22): n is a, c, g, or t
aaattgatccgagcaccggtnnkgtgaacctgctgaaaacaaa

SEQ ID NO: 5033 - DNA, 43 bp, Artificial Sequence
  Synthetic
  misc_feature (21)..(22): n is a, c, g, or t
ttgatccgagcaccggttttnnkaacctgctgaaaacaaaata

SEQ ID NO: 5034 - DNA, 43 bp, Artificial Sequence
  Synthetic
  misc_feature (21)..(22): n is a, c, g, or t
atccgagcaccggttttgtgnnkctgctgaaaacaaaatatac

SEQ ID NO: 5035 - DNA, 43 bp, Artificial Sequence
  Synthetic
  misc_feature (21)..(22): n is a, c, g, or t
cgagcaccggttttgtgaacnnkctgaaaacaaaatatacctc

SEQ ID NO: 5036 - DNA, 43 bp, Artificial Sequence
  Synthetic
  misc_feature (21)..(22): n is a, c, g, or t
gcaccggttttgtgaacctgnnkaaaacaaaatatacctccat

SEQ ID NO: 5037 - DNA, 43 bp, Artificial Sequence
  Synthetic
  misc_feature (21)..(22): n is a, c, g, or t
ccggttttgtgaacctgctgnnkacaaaatatacctccattgc

SEQ ID NO: 5038 - DNA, 43 bp, Artificial Sequence
  Synthetic
  misc_feature (21)..(22): n is a, c, g, or t
gttttgtgaacctgctgaaannkaaatatacctccattgccga

SEQ ID NO: 5039 - DNA, 43 bp, Artificial Sequence
  Synthetic
  misc_feature (21)..(22): n is a, c, g, or t
ttgtgaacctgctgaaaacannktatacctccattgccgacag

SEQ ID NO: 5040 - DNA, 43 bp, Artificial Sequence
  Synthetic
  misc_feature (21)..(22): n is a, c, g, or t
tgaacctgctgaaaacaaaannkacctccattgccgacagcaa

SEQ ID NO: 5041 - DNA, 43 bp, Artificial Sequence
  Synthetic
  misc_feature (21)..(22): n is a, c, g, or t
acctgctgaaaacaaaatatnnktccattgccgacagcaagaa

SEQ ID NO: 5042 - DNA, 43 bp, Artificial Sequence
  Synthetic
  misc_feature (21)..(22): n is a, c, g, or t
tgctgaaaacaaaatataccnnkattgccgacagcaagaagtt

SEQ ID NO: 5043 - DNA, 43 bp, Artificial Sequence
  Synthetic
  misc_feature (21)..(22): n is a, c, g, or t
tgaaaacaaaatatacctccnnkgccgacagcaagaagtttat

SEQ ID NO: 5044 - DNA, 43 bp, Artificial Sequence
  Synthetic
  misc_feature (21)..(22): n is a, c, g, or t
aaacaaaatatacctccattnnkgacagcaagaagtttattag

SEQ ID NO: 5045 - DNA, 43 bp, Artificial Sequence
  Synthetic
  misc_feature (21)..(22): n is a, c, g, or t
caaaatatacctccattgccnnkagcaagaagtttattagcag

SEQ ID NO: 5046 - DNA, 43 bp, Artificial Sequence
  Synthetic
  misc_feature (21)..(22): n is a, c, g, or t
aatatacctccattgccgacnnkaagaagtttattagcagctt

SEQ ID NO: 5047 - DNA, 43 bp, Artificial Sequence
  Synthetic
  misc_feature (21)..(22): n is a, c, g, or t
atacctccattgccgacagcnnkaagtttattagcagctttga

SEQ ID NO: 5048 - DNA, 43 bp, Artificial Sequence
  Synthetic
  misc_feature (21)..(22): n is a, c, g, or t
cctccattgccgacagcaagnnktttattagcagctttgatcg

SEQ ID NO: 5049 - DNA, 43 bp, Artificial Sequence
  Synthetic
  misc_feature (21)..(22): n is a, c, g, or t
ccattgccgacagcaagaagnnkattagcagctttgatcgcat

SEQ ID NO: 5050 - DNA, 43 bp, Artificial Sequence
  Synthetic
  misc_feature (21)..(22): n is a, c, g, or t
ttgccgacagcaagaagtttnnkagcagctttgatcgcattat

SEQ ID NO: 5051 - DNA, 43 bp, Artificial Sequence
  Synthetic
  misc_feature (21)..(22): n is a, c, g, or t
ccgacagcaagaagtttattnnkagctttgatcgcattatgta

SEQ ID NO: 5052 - DNA, 43 bp, Artificial Sequence
  Synthetic
  misc_feature (21)..(22): n is a, c, g, or t
acagcaagaagtttattagcnnktttgatcgcattatgtatgt

SEQ ID NO: 5053 - DNA, 43 bp, Artificial Sequence
  Synthetic
  misc_feature (21)..(22): n is a, c, g, or t
gcaagaagtttattagcagcnnkgatcgcattatgtatgttcc

SEQ ID NO: 5054 - DNA, 43 bp, Artificial Sequence
  Synthetic
  misc_feature (21)..(22): n is a, c, g, or t
agaagtttattagcagctttnnkcgcattatgtatgttccgga

SEQ ID NO: 5055 - DNA, 43 bp, Artificial Sequence
  Synthetic
  misc_feature (21)..(22): n is a, c, g, or t
agtttattagcagctttgatnnkattatgtatgttccggaaga

SEQ ID NO: 5056 - DNA, 43 bp, Artificial Sequence
  Synthetic
  misc_feature (21)..(22): n is a, c, g, or t
ttattagcagctttgatcgcnnkatgtatgttccggaagagga

SEQ ID NO: 5057 - DNA, 43 bp, Artificial Sequence
  Synthetic
  misc_feature (21)..(22): n is a, c, g, or t
ttagcagctttgatcgcattnnktatgttccggaagaggacct

SEQ ID NO: 5058 - DNA, 43 bp, Artificial Sequence
  Synthetic
  misc_feature (21)..(22): n is a, c, g, or t
gcagctttgatcgcattatgnnkgttccggaagaggacctgtt

SEQ ID NO: 5059 - DNA, 43 bp, Artificial Sequence
  Synthetic
  misc_feature (21)..(22): n is a, c, g, or t
gctttgatcgcattatgtatnnkccggaagaggacctgtttga

SEQ ID NO: 5060 - DNA, 43 bp, Artificial Sequence
  Synthetic
  misc_feature (21)..(22): n is a, c, g, or t
ttgatcgcattatgtatgttnnkgaagaggacctgtttgaatt

SEQ ID NO: 5061 - DNA, 43 bp, Artificial Sequence
  Synthetic
  misc_feature (21)..(22): n is a, c, g, or t
atcgcattatgtatgttccgnnkgaggacctgtttgaattcgc

SEQ ID NO: 5062 - DNA, 43 bp, Artificial Sequence
  Synthetic
  misc_feature (21)..(22): n is a, c, g, or t
gcattatgtatgttccggaannkgacctgtttgaattcgcact

SEQ ID NO: 5063 - DNA, 43 bp, Artificial Sequence
  Synthetic
  misc_feature (21)..(22): n is a, c, g, or t
ttatgtatgttccggaagagnnkctgtttgaattcgcactgga

SEQ ID NO: 5064 - DNA, 43 bp, Artificial Sequence
  Synthetic
  misc_feature (21)..(22): n is a, c, g, or t
tgtatgttccggaagaggacnnktttgaattcgcactggatta

SEQ ID NO: 5065 - DNA, 43 bp, Artificial Sequence
  Synthetic
  misc_feature (21)..(22): n is a, c, g, or t
atgttccggaagaggacctgnnkgaattcgcactggattacaa

SEQ ID NO: 5066 - DNA, 43 bp, Artificial Sequence
  Synthetic
  misc_feature (21)..(22): n is a, c, g, or t
ttccggaagaggacctgtttnnkttcgcactggattacaaaaa

SEQ ID NO: 5067 - DNA, 43 bp, Artificial Sequence
  Synthetic
  misc_feature (21)..(22): n is a, c, g, or t
cggaagaggacctgtttgaannkgcactggattacaaaaattt

SEQ ID NO: 5068 - DNA, 43 bp, Artificial Sequence
  Synthetic
  misc_feature (21)..(22): n is a, c, g, or t
aagaggacctgtttgaattcnnkctggattacaaaaatttcag

SEQ ID NO: 5069 - DNA, 43 bp, Artificial Sequence
  Synthetic
  misc_feature (21)..(22): n is a, c, g, or t
aggacctgtttgaattcgcannkgattacaaaaatttcagccg

SEQ ID NO: 5070 - DNA, 43 bp, Artificial Sequence
  Synthetic
  misc_feature (21)..(22): n is a, c, g, or t
acctgtttgaattcgcactgnnktacaaaaatttcagccgtac

SEQ ID NO: 5071 - DNA, 43 bp, Artificial Sequence
  Synthetic
  misc_feature (21)..(22): n is a, c, g, or t
tgtttgaattcgcactggatnnkaaaaatttcagccgtaccga

SEQ ID NO: 5072 - DNA, 43 bp, Artificial Sequence
  Synthetic
  misc_feature (21)..(22): n is a, c, g, or t
ttgaattcgcactggattacnnkaatttcagccgtaccgatgc

SEQ ID NO: 5073 - DNA, 43 bp, Artificial Sequence
  Synthetic
  misc_feature (21)..(22): n is a, c, g, or t
aattcgcactggattacaaannkttcagccgtaccgatgccga

SEQ ID NO: 5074 - DNA, 43 bp, Artificial Sequence
  Synthetic
  misc_feature (21)..(22): n is a, c, g, or t
tcgcactggattacaaaaatnnkagccgtaccgatgccgacta

SEQ ID NO: 5075 - DNA, 43 bp, Artificial Sequence
  Synthetic
  misc_feature (21)..(22): n is a, c, g, or t
cactggattacaaaaatttcnnkcgtaccgatgccgactacat

SEQ ID NO: 5076 - DNA, 43 bp, Artificial Sequence
  Synthetic
  misc_feature (21)..(22): n is a, c, g, or t
tggattacaaaaatttcagcnnkaccgatgccgactacatcaa

SEQ ID NO: 5077 - DNA, 43 bp, Artificial Sequence
  Synthetic
  misc_feature (21)..(22): n is a, c, g, or t
attacaaaaatttcagccgtnnkgatgccgactacatcaaaaa

SEQ ID NO: 5078 - DNA, 43 bp, Artificial Sequence
  Synthetic
  misc_feature (21)..(22): n is a, c, g, or t
acaaaaatttcagccgtaccnnkgccgactacatcaaaaaatg

SEQ ID NO: 5079 - DNA, 43 bp, Artificial Sequence
  Synthetic
  misc_feature (21)..(22): n is a, c, g, or t
aaaatttcagccgtaccgatnnkgactacatcaaaaaatggaa

SEQ ID NO: 5080 - DNA, 43 bp, Artificial Sequence
  Synthetic
  misc_feature (21)..(22): n is a, c, g, or t
atttcagccgtaccgatgccnnktacatcaaaaaatggaaact

SEQ ID NO: 5081 - DNA, 43 bp, Artificial Sequence
  Synthetic
  misc_feature (21)..(22): n is a, c, g, or t
tcagccgtaccgatgccgacnnkatcaaaaaatggaaactgta

SEQ ID NO: 5082 - DNA, 43 bp, Artificial Sequence
  Synthetic
  misc_feature (21)..(22): n is a, c, g, or t
gccgtaccgatgccgactacnnkaaaaaatggaaactgtacag

SEQ ID NO: 5083 - DNA, 43 bp, Artificial Sequence
  Synthetic
  misc_feature (21)..(22): n is a, c, g, or t
gtaccgatgccgactacatcnnkaaatggaaactgtacagcta

SEQ ID NO: 5084 - DNA, 43 bp, Artificial Sequence
  Synthetic
  misc_feature (21)..(22): n is a, c, g, or t
ccgatgccgactacatcaaannktggaaactgtacagctatgg

SEQ ID NO: 5085 - DNA, 43 bp, Artificial Sequence
  Synthetic
  misc_feature (21)..(22): n is a, c, g, or t
atgccgactacatcaaaaaannkaaactgtacagctatggtaa

SEQ ID NO: 5086 - DNA, 43 bp, Artificial Sequence
  Synthetic
  misc_feature (21)..(22): n is a, c, g, or t
ccgactacatcaaaaaatggnnkctgtacagctatggtaaccg

SEQ ID NO: 5087 - DNA, 43 bp, Artificial Sequence
  Synthetic
  misc_feature (21)..(22): n is a, c, g, or t
actacatcaaaaaatggaaannktacagctatggtaaccgcat

SEQ ID NO: 5088 - DNA, 43 bp, Artificial Sequence
  Synthetic
  misc_feature (21)..(22): n is a, c, g, or t
acatcaaaaaatggaaactgnnkagctatggtaaccgcattcg

SEQ ID NO: 5089 - DNA, 43 bp, Artificial Sequence
  Synthetic
  misc_feature (21)..(22): n is a, c, g, or t
tcaaaaaatggaaactgtacnnktatggtaaccgcattcgcat

SEQ ID NO: 5090 - DNA, 43 bp, Artificial Sequence
  Synthetic
  misc_feature (21)..(22): n is a, c, g, or t
aaaaatggaaactgtacagcnnkggtaaccgcattcgcatttt

SEQ ID NO: 5091 - DNA, 43 bp, Artificial Sequence
  Synthetic
  misc_feature (21)..(22): n is a, c, g, or t
aatggaaactgtacagctatnnkaaccgcattcgcatttttcg

SEQ ID NO: 5092 - DNA, 43 bp, Artificial Sequence
  Synthetic
  misc_feature (21)..(22): n is a, c, g, or t
ggaaactgtacagctatggtnnkcgcattcgcatttttcgcaa

SEQ ID NO: 5093 - DNA, 43 bp, Artificial Sequence
  Synthetic
  misc_feature (21)..(22): n is a, c, g, or t
aactgtacagctatggtaacnnkattcgcatttttcgcaaccc

SEQ ID NO: 5094 - DNA, 43 bp, Artificial Sequence
  Synthetic
  misc_feature (21)..(22): n is a, c, g, or t
tgtacagctatggtaaccgcnnkcgcatttttcgcaacccgaa

SEQ ID NO: 5095 - DNA, 43 bp, Artificial Sequence
  Synthetic
  misc_feature (21)..(22): n is a, c, g, or t
acagctatggtaaccgcattnnkatttttcgcaacccgaagaa

SEQ ID NO: 5096 - DNA, 43 bp, Artificial Sequence
  Synthetic
  misc_feature (21)..(22): n is a, c, g, or t
gctatggtaaccgcattcgcnnktttcgcaacccgaagaaaaa

SEQ ID NO: 5097 - DNA, 43 bp, Artificial Sequence
  Synthetic
  misc_feature (21)..(22): n is a, c, g, or t
atggtaaccgcattcgcattnnkcgcaacccgaagaaaaacaa

SEQ ID NO: 5098 - DNA, 43 bp, Artificial Sequence
  Synthetic
  misc_feature (21)..(22): n is a, c, g, or t
gtaaccgcattcgcatttttnnkaacccgaagaaaaacaatgt

SEQ ID NO: 5099 - DNA, 43 bp, Artificial Sequence
  Synthetic
  misc_feature (21)..(22): n is a, c, g, or t
accgcattcgcatttttcgcnnkccgaagaaaaacaatgtgtt

SEQ ID NO: 5100 - DNA, 43 bp, Artificial Sequence
  Synthetic
  misc_feature (21)..(22): n is a, c, g, or t
gcattcgcatttttcgcaacnnkaagaaaaacaatgtgttcga

SEQ ID NO: 5101 - DNA, 43 bp, Artificial Sequence
  Synthetic
  misc_feature (21)..(22): n is a, c, g, or t
ttcgcatttttcgcaacccgnnkaaaaacaatgtgttcgattg

SEQ ID NO: 5102 - DNA, 43 bp, Artificial Sequence
  Synthetic
  misc_feature (21)..(22): n is a, c, g, or t
gcatttttcgcaacccgaagnnkaacaatgtgttcgattggga

SEQ ID NO: 5103 - DNA, 43 bp, Artificial Sequence
  Synthetic
  misc_feature (21)..(22): n is a, c, g, or t
tttttcgcaacccgaagaaannkaatgtgttcgattgggaaga

SEQ ID NO: 5104 - DNA, 43 bp, Artificial Sequence
  Synthetic
  misc_feature (21)..(22): n is a, c, g, or t
ttcgcaacccgaagaaaaacnnkgtgttcgattgggaagaagt

SEQ ID NO: 5105 - DNA, 43 bp, Artificial Sequence
  Synthetic
  misc_feature (21)..(22): n is a, c, g, or t
gcaacccgaagaaaaacaatnnkttcgattgggaagaagtttg

SEQ ID NO: 5106 - DNA, 43 bp, Artificial Sequence
  Synthetic
  misc_feature (21)..(22): n is a, c, g, or t
acccgaagaaaaacaatgtgnnkgattgggaagaagtttgtct

SEQ ID NO: 5107 - DNA, 43 bp, Artificial Sequence
  Synthetic
  misc_feature (21)..(22): n is a, c, g, or t
cgaagaaaaacaatgtgttcnnktgggaagaagtttgtctgac

SEQ ID NO: 5108 - DNA, 43 bp, Artificial Sequence
  Synthetic
  misc_feature (21)..(22): n is a, c, g, or t
agaaaaacaatgtgttcgatnnkgaagaagtttgtctgaccag

SEQ ID NO: 5109 - DNA, 43 bp, Artificial Sequence
  Synthetic
  misc_feature (21)..(22): n is a, c, g, or t
aaaacaatgtgttcgattggnnkgaagtttgtctgaccagcgc

SEQ ID NO: 5110 - DNA, 43 bp, Artificial Sequence
  Synthetic
  misc_feature (21)..(22): n is a, c, g, or t
acaatgtgttcgattgggaannkgtttgtctgaccagcgcata

SEQ ID NO: 5111 - DNA, 43 bp, Artificial Sequence
  Synthetic
  misc_feature (21)..(22): n is a, c, g, or t
atgtgttcgattgggaagaannktgtctgaccagcgcatataa

SEQ ID NO: 5112 - DNA, 43 bp, Artificial Sequence
  Synthetic
  misc_feature (21)..(22): n is a, c, g, or t
tgttcgattgggaagaagttnnkctgaccagcgcatataaaga

SEQ ID NO: 5113 - DNA, 43 bp, Artificial Sequence
  Synthetic
  misc_feature (21)..(22): n is a, c, g, or t
tcgattgggaagaagtttgtnnkaccagcgcatataaagaact

SEQ ID NO: 5114 - DNA, 43 bp, Artificial Sequence
  Synthetic
  misc_feature (21)..(22): n is a, c, g, or t
attgggaagaagtttgtctgnnkagcgcatataaagaactttt

SEQ ID NO: 5115 - DNA, 43 bp, Artificial Sequence
  Synthetic
  misc_feature (21)..(22): n is a, c, g, or t
gggaagaagtttgtctgaccnnkgcatataaagaacttttcaa

SEQ ID NO: 5116 - DNA, 43 bp, Artificial Sequence
  Synthetic
  misc_feature (21)..(22): n is a, c, g, or t
aagaagtttgtctgaccagcnnktataaagaacttttcaacaa

SEQ ID NO: 5117 - DNA, 43 bp, Artificial Sequence
  Synthetic
  misc_feature (21)..(22): n is a, c, g, or t
aagtttgtctgaccagcgcannkaaagaacttttcaacaaata

SEQ ID NO: 5118 - DNA, 43 bp, Artificial Sequence
  Synthetic
  misc_feature (21)..(22): n is a, c, g, or t
tttgtctgaccagcgcatatnnkgaacttttcaacaaatacgg

SEQ ID NO: 5119 - DNA, 43 bp, Artificial Sequence
  Synthetic
  misc_feature (21)..(22): n is a, c, g, or t
gtctgaccagcgcatataaannkcttttcaacaaatacggcat

SEQ ID NO: 5120 - DNA, 43 bp, Artificial Sequence
  Synthetic
  misc_feature (21)..(22): n is a, c, g, or t
tgaccagcgcatataaagaannkttcaacaaatacggcatcaa

SEQ ID NO: 5121 - DNA, 43 bp, Artificial Sequence
  Synthetic
  misc_feature (21)..(22): n is a, c, g, or t
ccagcgcatataaagaacttnnkaacaaatacggcatcaacta

SEQ ID NO: 5122 - DNA, 43 bp, Artificial Sequence
  Synthetic
  misc_feature (21)..(22): n is a, c, g, or t
gcgcatataaagaacttttcnnkaaatacggcatcaactatca

SEQ ID NO: 5123 - DNA, 43 bp, Artificial Sequence
  Synthetic
  misc_feature (21)..(22): n is a, c, g, or t
catataaagaacttttcaacnnktacggcatcaactatcagca

SEQ ID NO: 5124 - DNA, 43 bp, Artificial Sequence
  Synthetic
  misc_feature (21)..(22): n is a, c, g, or t
ataaagaacttttcaacaaannkggcatcaactatcagcaggg

SEQ ID NO: 5125 - DNA, 43 bp, Artificial Sequence
  Synthetic
  misc_feature (21)..(22): n is a, c, g, or t
aagaacttttcaacaaatacnnkatcaactatcagcagggtga

SEQ ID NO: 5126 - DNA, 43 bp, Artificial Sequence
  Synthetic
  misc_feature (21)..(22): n is a, c, g, or t
aacttttcaacaaatacggcnnkaactatcagcagggtgatat

SEQ ID NO: 5127 - DNA, 43 bp, Artificial Sequence
  Synthetic
  misc_feature (21)..(22): n is a, c, g, or t
ttttcaacaaatacggcatcnnktatcagcagggtgatattcg

SEQ ID NO: 5128 - DNA, 43 bp, Artificial Sequence
  Synthetic
  misc_feature (21)..(22): n is a, c, g, or t
tcaacaaatacggcatcaacnnkcagcagggtgatattcgtgc

SEQ ID NO: 5129 - DNA, 43 bp, Artificial Sequence
  Synthetic
  misc_feature (21)..(22): n is a, c, g, or t
acaaatacggcatcaactatnnkcagggtgatattcgtgcact

SEQ ID NO: 5130 - DNA, 43 bp, Artificial Sequence
  Synthetic
  misc_feature (21)..(22): n is a, c, g, or t
aatacggcatcaactatcagnnkggtgatattcgtgcactgct

SEQ ID NO: 5131 - DNA, 43 bp, Artificial Sequence
  Synthetic
  misc_feature (21)..(22): n is a, c, g, or t
acggcatcaactatcagcagnnkgatattcgtgcactgctgtg

SEQ ID NO: 5132 - DNA, 43 bp, Artificial Sequence
  Synthetic
  misc_feature (21)..(22): n is a, c, g, or t
gcatcaactatcagcagggtnnkattcgtgcactgctgtgtga

SEQ ID NO: 5133 - DNA, 43 bp, Artificial Sequence
  Synthetic
  misc_feature (21)..(22): n is a, c, g, or t
tcaactatcagcagggtgatnnkcgtgcactgctgtgtgaaca

SEQ ID NO: 5134 - DNA, 43 bp, Artificial Sequence
  Synthetic
  misc_feature (21)..(22): n is a, c, g, or t
actatcagcagggtgatattnnkgcactgctgtgtgaacagag

SEQ ID NO: 5135 - DNA, 43 bp, Artificial Sequence
  Synthetic
  misc_feature (21)..(22): n is a, c, g, or t
atcagcagggtgatattcgtnnkctgctgtgtgaacagagcga

SEQ ID NO: 5136 - DNA, 43 bp, Artificial Sequence
  Synthetic
  misc_feature (21)..(22): n is a, c, g, or t
agcagggtgatattcgtgcannkctgtgtgaacagagcgataa

SEQ ID NO: 5137 - DNA, 43 bp, Artificial Sequence
  Synthetic
  misc_feature (21)..(22): n is a, c, g, or t
agggtgatattcgtgcactgnnktgtgaacagagcgataaagc

SEQ ID NO: 5138 - DNA, 43 bp, Artificial Sequence
  Synthetic
  misc_feature (21)..(22): n is a, c, g, or t
gtgatattcgtgcactgctgnnkgaacagagcgataaagcgtt

SEQ ID NO: 5139 - DNA, 43 bp, Artificial Sequence
  Synthetic
  misc_feature (21)..(22): n is a, c, g, or t
atattcgtgcactgctgtgtnnkcagagcgataaagcgtttta

SEQ ID NO: 5140 - DNA, 43 bp, Artificial Sequence
  Synthetic
  misc_feature (21)..(22): n is a, c, g, or t
ttcgtgcactgctgtgtgaannkagcgataaagcgttttatag

SEQ ID NO: 5141 - DNA, 43 bp, Artificial Sequence
  Synthetic
  misc_feature (21)..(22): n is a, c, g, or t
gtgcactgctgtgtgaacagnnkgataaagcgttttatagcag

SEQ ID NO: 5142 - DNA, 43 bp, Artificial Sequence
  Synthetic
  misc_feature (21)..(22): n is a, c, g, or t
cactgctgtgtgaacagagcnnkaaagcgttttatagcagttt

SEQ ID NO: 5143 - DNA, 43 bp, Artificial Sequence
  Synthetic
  misc_feature (21)..(22): n is a, c, g, or t
tgctgtgtgaacagagcgatnnkgcgttttatagcagttttat

SEQ ID NO: 5144 - DNA, 43 bp, Artificial Sequence
  Synthetic
  misc_feature (21)..(22): n is a, c, g, or t
tgtgtgaacagagcgataaannkttttatagcagttttatggc

SEQ ID NO: 5145 - DNA, 43 bp, Artificial Sequence
  Synthetic
  misc_feature (21)..(22): n is a, c, g, or t
gtgaacagagcgataaagcgnnktatagcagttttatggcact

SEQ ID NO: 5146 - DNA, 43 bp, Artificial Sequence
  Synthetic
  misc_feature (21)..(22): n is a, c, g, or t
aacagagcgataaagcgtttnnkagcagttttatggcactgat

SEQ ID NO: 5147 - DNA, 43 bp, Artificial Sequence
  Synthetic
  misc_feature (21)..(22): n is a, c, g, or t
agagcgataaagcgttttatnnkagttttatggcactgatgag

SEQ ID NO: 5148 - DNA, 43 bp, Artificial Sequence
  Synthetic
  misc_feature (21)..(22): n is a, c, g, or t
gcgataaagcgttttatagcnnktttatggcactgatgagcct

SEQ ID NO: 5149 - DNA, 43 bp, Artificial Sequence
  Synthetic
  misc_feature (21)..(22): n is a, c, g, or t
ataaagcgttttatagcagtnnkatggcactgatgagcctgat

SEQ ID NO: 5150 - DNA, 43 bp, Artificial Sequence
  Synthetic
  misc_feature (21)..(22): n is a, c, g, or t
aagcgttttatagcagttttnnkgcactgatgagcctgatgct

SEQ ID NO: 5151 - DNA, 43 bp, Artificial Sequence
  Synthetic
  misc_feature (21)..(22): n is a, c, g, or t
cgttttatagcagttttatgnnkctgatgagcctgatgctgca

SEQ ID NO: 5152 - DNA, 43 bp, Artificial Sequence
  Synthetic
  misc_feature (21)..(22): n is a, c, g, or t
tttatagcagttttatggcannkatgagcctgatgctgcagat

SEQ ID NO: 5153 - DNA, 43 bp, Artificial Sequence
  Synthetic
  misc_feature (21)..(22): n is a, c, g, or t
atagcagttttatggcactgnnkagcctgatgctgcagatgcg

SEQ ID NO: 5154 - DNA, 43 bp, Artificial Sequence
  Synthetic
  misc_feature (21)..(22): n is a, c, g, or t
gcagttttatggcactgatgnnkctgatgctgcagatgcgtaa

SEQ ID NO: 5155 - DNA, 43 bp, Artificial Sequence
  Synthetic
  misc_feature (21)..(22): n is a, c, g, or t
gttttatggcactgatgagcnnkatgctgcagatgcgtaatag

SEQ ID NO: 5156 - DNA, 43 bp, Artificial Sequence
  Synthetic
  misc_feature (21)..(22): n is a, c, g, or t
ttatggcactgatgagcctgnnkctgcagatgcgtaatagcat

SEQ ID NO: 5157 - DNA, 43 bp, Artificial Sequence
  Synthetic
  misc_feature (21)..(22): n is a, c, g, or t
tggcactgatgagcctgatgnnkcagatgcgtaatagcattac

SEQ ID NO: 5158 - DNA, 43 bp, Artificial Sequence
  Synthetic
  misc_feature (21)..(22): n is a, c, g, or t
cactgatgagcctgatgctgnnkatgcgtaatagcattaccgg

SEQ ID NO: 5159 - DNA, 43 bp, Artificial Sequence
  Synthetic
  misc_feature (21)..(22): n is a, c, g, or t
tgatgagcctgatgctgcagnnkcgtaatagcattaccggtcg

SEQ ID NO: 5160 - DNA, 43 bp, Artificial Sequence
  Synthetic
  misc_feature (21)..(22): n is a, c, g, or t
tgagcctgatgctgcagatgnnkaatagcattaccggtcgcac

SEQ ID NO: 5161 - DNA, 43 bp, Artificial Sequence
  Synthetic
  misc_feature (21)..(22): n is a, c, g, or t
gcctgatgctgcagatgcgtnnkagcattaccggtcgcaccga

SEQ ID NO: 5162 - DNA, 43 bp, Artificial Sequence
  Synthetic
  misc_feature (21)..(22): n is a, c, g, or t
tgatgctgcagatgcgtaatnnkattaccggtcgcaccgatgt

SEQ ID NO: 5163 - DNA, 43 bp, Artificial Sequence
  Synthetic
  misc_feature (21)..(22): n is a, c, g, or t
tgctgcagatgcgtaatagcnnkaccggtcgcaccgatgtgga

SEQ ID NO: 5164 - DNA, 43 bp, Artificial Sequence
  Synthetic
  misc_feature (21)..(22): n is a, c, g, or t
tgcagatgcgtaatagcattnnkggtcgcaccgatgtggattt

SEQ ID NO: 5165 - DNA, 43 bp, Artificial Sequence
  Synthetic
  misc_feature (21)..(22): n is a, c, g, or t
agatgcgtaatagcattaccnnkcgcaccgatgtggattttct

SEQ ID NO: 5166 - DNA, 43 bp, Artificial Sequence
  Synthetic
  misc_feature (21)..(22): n is a, c, g, or t
tgcgtaatagcattaccggtnnkaccgatgtggattttctgat

SEQ ID NO: 5167 - DNA, 43 bp, Artificial Sequence
  Synthetic
  misc_feature (21)..(22): n is a, c, g, or t
gtaatagcattaccggtcgcnnkgatgtggattttctgattag

SEQ ID NO: 5168 - DNA, 43 bp, Artificial Sequence
  Synthetic
  misc_feature (21)..(22): n is a, c, g, or t
atagcattaccggtcgcaccnnkgtggattttctgattagtcc

SEQ ID NO: 5169 - DNA, 43 bp, Artificial Sequence
  Synthetic
  misc_feature (21)..(22): n is a, c, g, or t
gcattaccggtcgcaccgatnnkgattttctgattagtccggt

SEQ ID NO: 5170 - DNA, 43 bp, Artificial Sequence
  Synthetic
  misc_feature (21)..(22): n is a, c, g, or t
ttaccggtcgcaccgatgtgnnktttctgattagtccggtgaa

SEQ ID NO: 5171 - DNA, 43 bp, Artificial Sequence
  Synthetic
  misc_feature (21)..(22): n is a, c, g, or t
ccggtcgcaccgatgtggatnnkctgattagtccggtgaaaaa

SEQ ID NO: 5172 - DNA, 43 bp, Artificial Sequence
  Synthetic
  misc_feature (21)..(22): n is a, c, g, or t
gtcgcaccgatgtggattttnnkattagtccggtgaaaaattc

SEQ ID NO: 5173 - DNA, 43 bp, Artificial Sequence
  Synthetic
  misc_feature (21)..(22): n is a, c, g, or t
gcaccgatgtggattttctgnnkagtccggtgaaaaattccga

SEQ ID NO: 5174 - DNA, 43 bp, Artificial Sequence
  Synthetic
  misc_feature (21)..(22): n is a, c, g, or t
ccgatgtggattttctgattnnkccggtgaaaaattccgatgg

SEQ ID NO: 5175 - DNA, 43 bp, Artificial Sequence
  Synthetic
  misc_feature (21)..(22): n is a, c, g, or t
atgtggattttctgattagtnnkgtgaaaaattccgatggcat

SEQ ID NO: 5176 - DNA, 43 bp, Artificial Sequence
  Synthetic
  misc_feature (21)..(22): n is a, c, g, or t
tggattttctgattagtccgnnkaaaaattccgatggcatctt

SEQ ID NO: 5177 - DNA, 43 bp, Artificial Sequence
  Synthetic
  misc_feature (21)..(22): n is a, c, g, or t
attttctgattagtccggtgnnkaattccgatggcatctttta

SEQ ID NO: 5178 - DNA, 43 bp, Artificial Sequence
  Synthetic
  misc_feature (21)..(22): n is a, c, g, or t
ttctgattagtccggtgaaannktccgatggcatcttttatga

SEQ ID NO: 5179 - DNA, 43 bp, Artificial Sequence
  Synthetic
  misc_feature (21)..(22): n is a, c, g, or t
tgattagtccggtgaaaaatnnkgatggcatcttttatgatag

SEQ ID NO: 5180 - DNA, 43 bp, Artificial Sequence
  Synthetic
  misc_feature (21)..(22): n is a, c, g, or t
ttagtccggtgaaaaattccnnkggcatcttttatgatagccg

SEQ ID NO: 5181 - DNA, 43 bp, Artificial Sequence
  Synthetic
  misc_feature (21)..(22): n is a, c, g, or t
gtccggtgaaaaattccgatnnkatcttttatgatagccgcaa

SEQ ID NO: 5182 - DNA, 43 bp, Artificial Sequence
  Synthetic
  misc_feature (21)..(22): n is a, c, g, or t
cggtgaaaaattccgatggcnnkttttatgatagccgcaatta

SEQ ID NO: 5183 - DNA, 43 bp, Artificial Sequence
  Synthetic
  misc_feature (21)..(22): n is a, c, g, or t
tgaaaaattccgatggcatcnnktatgatagccgcaattacga

SEQ ID NO: 5184 - DNA, 43 bp, Artificial Sequence
  Synthetic
  misc_feature (21)..(22): n is a, c, g, or t
aaaattccgatggcatctttnnkgatagccgcaattacgaagc

SEQ ID NO: 5185 - DNA, 43 bp, Artificial Sequence
  Synthetic
  misc_feature (21)..(22): n is a, c, g, or t
attccgatggcatcttttatnnkagccgcaattacgaagcaca

SEQ ID NO: 5186 - DNA, 43 bp, Artificial Sequence
  Synthetic
  misc_feature (21)..(22): n is a, c, g, or t
ccgatggcatcttttatgatnnkcgcaattacgaagcacaaga

SEQ ID NO: 5187 - DNA, 43 bp, Artificial Sequence
  Synthetic
  misc_feature (21)..(22): n is a, c, g, or t
atggcatcttttatgatagcnnkaattacgaagcacaagaaaa

SEQ ID NO: 5188 - DNA, 43 bp, Artificial Sequence
  Synthetic
  misc_feature (21)..(22): n is a, c, g, or t
gcatcttttatgatagccgcnnktacgaagcacaagaaaatgc

SEQ ID NO: 5189 - DNA, 43 bp, Artificial Sequence
  Synthetic
  misc_feature (21)..(22): n is a, c, g, or t
tcttttatgatagccgcaatnnkgaagcacaagaaaatgcaat

SEQ ID NO: 5190 - DNA, 43 bp, Artificial Sequence
  Synthetic
  misc_feature (21)..(22): n is a, c, g, or t
tttatgatagccgcaattacnnkgcacaagaaaatgcaattct

SEQ ID NO: 5191 - DNA, 43 bp, Artificial Sequence
  Synthetic
  misc_feature (21)..(22): n is a, c, g, or t
atgatagccgcaattacgaannkcaagaaaatgcaattctgcc

SEQ ID NO: 5192 - DNA, 43 bp, Artificial Sequence
  Synthetic
  misc_feature (21)..(22): n is a, c, g, or t
atagccgcaattacgaagcannkgaaaatgcaattctgccgaa

SEQ ID NO: 5193 - DNA, 43 bp, Artificial Sequence
  Synthetic
  misc_feature (21)..(22): n is a, c, g, or t
gccgcaattacgaagcacaannkaatgcaattctgccgaaaaa

SEQ ID NO: 5194 - DNA, 43 bp, Artificial Sequence
  Synthetic
  misc_feature (21)..(22): n is a, c, g, or t
gcaattacgaagcacaagaannkgcaattctgccgaaaaacgc

SEQ ID NO: 5195 - DNA, 43 bp, Artificial Sequence
  Synthetic
  misc_feature (21)..(22): n is a, c, g, or t
attacgaagcacaagaaaatnnkattctgccgaaaaacgcaga

SEQ ID NO: 5196 - DNA, 43 bp, Artificial Sequence
  Synthetic
  misc_feature (21)..(22): n is a, c, g, or t
acgaagcacaagaaaatgcannkctgccgaaaaacgcagatgc

SEQ ID NO: 5197 - DNA, 43 bp, Artificial Sequence
  Synthetic
  misc_feature (21)..(22): n is a, c, g, or t
aagcacaagaaaatgcaattnnkccgaaaaacgcagatgcaaa

SEQ ID NO: 5198 - DNA, 43 bp, Artificial Sequence
  Synthetic
  misc_feature (21)..(22): n is a, c, g, or t
cacaagaaaatgcaattctgnnkaaaaacgcagatgcaaatgg

SEQ ID NO: 5199 - DNA, 43 bp, Artificial Sequence
  Synthetic
  misc_feature (21)..(22): n is a, c, g, or t
aagaaaatgcaattctgccgnnkaacgcagatgcaaatggtgc

SEQ ID NO: 5200 - DNA, 43 bp, Artificial Sequence
  Synthetic
  misc_feature (21)..(22): n is a, c, g, or t
aaaatgcaattctgccgaaannkgcagatgcaaatggtgcata

SEQ ID NO: 5201 - DNA, 43 bp, Artificial Sequence
  Synthetic
  misc_feature (21)..(22): n is a, c, g, or t
atgcaattctgccgaaaaacnnkgatgcaaatggtgcatataa

SEQ ID NO: 5202 - DNA, 43 bp, Artificial Sequence
  Synthetic
  misc_feature (21)..(22): n is a, c, g, or t
caattctgccgaaaaacgcannkgcaaatggtgcatataacat

SEQ ID NO: 5203 - DNA, 43 bp, Artificial Sequence
  Synthetic
  misc_feature (21)..(22): n is a, c, g, or t
ttctgccgaaaaacgcagatnnkaatggtgcatataacattgc

SEQ ID NO: 5204 - DNA, 43 bp, Artificial Sequence
  Synthetic
  misc_feature (21)..(22): n is a, c, g, or t
tgccgaaaaacgcagatgcannkggtgcatataacattgcacg

SEQ ID NO: 5205 - DNA, 43 bp, Artificial Sequence
  Synthetic
  misc_feature (21)..(22): n is a, c, g, or t
cgaaaaacgcagatgcaaatnnkgcatataacattgcacgtaa

SEQ ID NO: 5206 - DNA, 43 bp, Artificial Sequence
  Synthetic
  misc_feature (21)..(22): n is a, c, g, or t
aaaacgcagatgcaaatggtnnktataacattgcacgtaaagt

SEQ ID NO: 5207 - DNA, 43 bp, Artificial Sequence
  Synthetic
  misc_feature (21)..(22): n is a, c, g, or t
acgcagatgcaaatggtgcannkaacattgcacgtaaagttct

SEQ ID NO: 5208 - DNA, 43 bp, Artificial Sequence
  Synthetic
  misc_feature (21)..(22): n is a, c, g, or t
cagatgcaaatggtgcatatnnkattgcacgtaaagttctgtg

SEQ ID NO: 5209 - DNA, 43 bp, Artificial Sequence
  Synthetic
  misc_feature (21)..(22): n is a, c, g, or t
atgcaaatggtgcatataacnnkgcacgtaaagttctgtgggc

SEQ ID NO: 5210 - DNA, 43 bp, Artificial Sequence
  Synthetic
  misc_feature (21)..(22): n is a, c, g, or t
caaatggtgcatataacattnnkcgtaaagttctgtgggcaat

SEQ ID NO: 5211 - DNA, 43 bp, Artificial Sequence
  Synthetic
  misc_feature (21)..(22): n is a, c, g, or t
atggtgcatataacattgcannkaaagttctgtgggcaattgg

SEQ ID NO: 5212 - DNA, 43 bp, Artificial Sequence
  Synthetic
  misc_feature (21)..(22): n is a, c, g, or t
gtgcatataacattgcacgtnnkgttctgtgggcaattggcca

SEQ ID NO: 5213 - DNA, 43 bp, Artificial Sequence
  Synthetic
  misc_feature (21)..(22): n is a, c, g, or t
catataacattgcacgtaaannkctgtgggcaattggccagtt

SEQ ID NO: 5214 - DNA, 43 bp, Artificial Sequence
  Synthetic
  misc_feature (21)..(22): n is a, c, g, or t
ataacattgcacgtaaagttnnktgggcaattggccagtttaa

SEQ ID NO: 5215 - DNA, 43 bp, Artificial Sequence
  Synthetic
  misc_feature (21)..(22): n is a, c, g, or t
acattgcacgtaaagttctgnnkgcaattggccagtttaagaa

SEQ ID NO: 5216 - DNA, 43 bp, Artificial Sequence
  Synthetic
  misc_feature (21)..(22): n is a, c, g, or t
ttgcacgtaaagttctgtggnnkattggccagtttaagaaagc

SEQ ID NO: 5217 - DNA, 43 bp, Artificial Sequence
  Synthetic
  misc_feature (21)..(22): n is a, c, g, or t
cacgtaaagttctgtgggcannkggccagtttaagaaagcaga

SEQ ID NO: 5218 - DNA, 43 bp, Artificial Sequence
  Synthetic
  misc_feature (21)..(22): n is a, c, g, or t
gtaaagttctgtgggcaattnnkcagtttaagaaagcagaaga

SEQ ID NO: 5219 - DNA, 43 bp, Artificial Sequence
  Synthetic
  misc_feature (21)..(22): n is a, c, g, or t
aagttctgtgggcaattggcnnktttaagaaagcagaagatga

SEQ ID NO: 5220 - DNA, 43 bp, Artificial Sequence
  Synthetic
  misc_feature (21)..(22): n is a, c, g, or t
ttctgtgggcaattggccagnnkaagaaagcagaagatgagaa

SEQ ID NO: 5221 - DNA, 43 bp, Artificial Sequence
  Synthetic
  misc_feature (21)..(22): n is a, c, g, or t
tgtgggcaattggccagtttnnkaaagcagaagatgagaagct

SEQ ID NO: 5222 - DNA, 43 bp, Artificial Sequence
  Synthetic
  misc_feature (21)..(22): n is a, c, g, or t
gggcaattggccagtttaagnnkgcagaagatgagaagctgga

SEQ ID NO: 5223 - DNA, 43 bp, Artificial Sequence
  Synthetic
  misc_feature (21)..(22): n is a, c, g, or t
caattggccagtttaagaaannkgaagatgagaagctggacaa

SEQ ID NO: 5224 - DNA, 43 bp, Artificial Sequence
  Synthetic
  misc_feature (21)..(22): n is a, c, g, or t
ttggccagtttaagaaagcannkgatgagaagctggacaaagt

SEQ ID NO: 5225 - DNA, 43 bp, Artificial Sequence
  Synthetic
  misc_feature (21)..(22): n is a, c, g, or t
gccagtttaagaaagcagaannkgagaagctggacaaagtgaa

SEQ ID NO: 5226 - DNA, 43 bp, Artificial Sequence
  Synthetic
  misc_feature (21)..(22): n is a, c, g, or t
agtttaagaaagcagaagatnnkaagctggacaaagtgaaaat

SEQ ID NO: 5227 - DNA, 43 bp, Artificial Sequence
  Synthetic
  misc_feature (21)..(22): n is a, c, g, or t
ttaagaaagcagaagatgagnnkctggacaaagtgaaaattgc

SEQ ID NO: 5228 - DNA, 43 bp, Artificial Sequence
  Synthetic
  misc_feature (21)..(22): n is a, c, g, or t
agaaagcagaagatgagaagnnkgacaaagtgaaaattgcgat

SEQ ID NO: 5229 - DNA, 43 bp, Artificial Sequence
  Synthetic
  misc_feature (21)..(22): n is a, c, g, or t
aagcagaagatgagaagctgnnkaaagtgaaaattgcgatcag

SEQ ID NO: 5230 - DNA, 43 bp, Artificial Sequence
  Synthetic
  misc_feature (21)..(22): n is a, c, g, or t
cagaagatgagaagctggacnnkgtgaaaattgcgatcagcaa

SEQ ID NO: 5231 - DNA, 43 bp, Artificial Sequence
  Synthetic
  misc_feature (21)..(22): n is a, c, g, or t
aagatgagaagctggacaaannkaaaattgcgatcagcaataa

SEQ ID NO: 5232 - DNA, 43 bp, Artificial Sequence
  Synthetic
  misc_feature (21)..(22): n is a, c, g, or t
atgagaagctggacaaagtgnnkattgcgatcagcaataaaga

SEQ ID NO: 5233 - DNA, 43 bp, Artificial Sequence
  Synthetic
  misc_feature (21)..(22): n is a, c, g, or t
agaagctggacaaagtgaaannkgcgatcagcaataaagagtg

SEQ ID NO: 5234 - DNA, 43 bp, Artificial Sequence
  Synthetic
  misc_feature (21)..(22): n is a, c, g, or t
agctggacaaagtgaaaattnnkatcagcaataaagagtggct

SEQ ID NO: 5235 - DNA, 43 bp, Artificial Sequence
  Synthetic
  misc_feature (21)..(22): n is a, c, g, or t
tggacaaagtgaaaattgcgnnkagcaataaagagtggctgga

SEQ ID NO: 5236 - DNA, 43 bp, Artificial Sequence
  Synthetic
  misc_feature (21)..(22): n is a, c, g, or t
acaaagtgaaaattgcgatcnnkaataaagagtggctggaata

SEQ ID NO: 5237 - DNA, 43 bp, Artificial Sequence
  Synthetic
  misc_feature (21)..(22): n is a, c, g, or t
aagtgaaaattgcgatcagcnnkaaagagtggctggaatacgc

SEQ ID NO: 5238 - DNA, 43 bp, Artificial Sequence
  Synthetic
  misc_feature (21)..(22): n is a, c, g, or t
tgaaaattgcgatcagcaatnnkgagtggctggaatacgcaca

SEQ ID NO: 5239 - DNA, 43 bp, Artificial Sequence
  Synthetic
  misc_feature (21)..(22): n is a, c, g, or t
aaattgcgatcagcaataaannktggctggaatacgcacagac

SEQ ID NO: 5240 - DNA, 43 bp, Artificial Sequence
  Synthetic
  misc_feature (21)..(22): n is a, c, g, or t
ttgcgatcagcaataaagagnnkctggaatacgcacagaccag

SEQ ID NO: 5241 - DNA, 43 bp, Artificial Sequence
  Synthetic
  misc_feature (21)..(22): n is a, c, g, or t
cgatcagcaataaagagtggnnkgaatacgcacagaccagcgt

SEQ ID NO: 5242 - DNA, 43 bp, Artificial Sequence
  Synthetic
  misc_feature (21)..(22): n is a, c, g, or t
tcagcaataaagagtggctgnnktacgcacagaccagcgttaa

SEQ ID NO: 5243 - DNA, 43 bp, Artificial Sequence
  Synthetic
  misc_feature (21)..(22): n is a, c, g, or t
gcaataaagagtggctggaannkgcacagaccagcgttaaaca

SEQ ID NO: 5244 - DNA, 43 bp, Artificial Sequence
  Synthetic
  misc_feature (21)..(22): n is a, c, g, or t
ataaagagtggctggaatacnnkcagaccagcgttaaacatgg

SEQ ID NO: 5245 - DNA, 43 bp, Artificial Sequence
  Synthetic
  misc_feature (21)..(22): n is a, c, g, or t
aagagtggctggaatacgcannkaccagcgttaaacatggtcg

SEQ ID NO: 5246 - DNA, 43 bp, Artificial Sequence
  Synthetic
  misc_feature (21)..(22): n is a, c, g, or t
agtggctggaatacgcacagnnkagcgttaaacatggtcgtag

SEQ ID NO: 5247 - DNA, 43 bp, Artificial Sequence
  Synthetic
  misc_feature (21)..(22): n is a, c, g, or t
ggctggaatacgcacagaccnnkgttaaacatggtcgtagcag

SEQ ID NO: 5248 - DNA, 43 bp, Artificial Sequence
  Synthetic
  misc_feature (21)..(22): n is a, c, g, or t
tggaatacgcacagaccagcnnkaaacatggtcgtagcagtga

SEQ ID NO: 5249 - DNA, 43 bp, Artificial Sequence
  Synthetic
  misc_feature (21)..(22): n is a, c, g, or t
aatacgcacagaccagcgttnnkcatggtcgtagcagtgatga

SEQ ID NO: 5250 - DNA, 43 bp, Artificial Sequence
  Synthetic
  misc_feature (21)..(22): n is a, c, g, or t
acgcacagaccagcgttaaannkggtcgtagcagtgatgatga

SEQ ID NO: 5251 - DNA, 43 bp, Artificial Sequence
  Synthetic
cctgaacaactatatcagcctggaacgtaaaaaaacccgcacc

SEQ ID NO: 5252 - DNA, 43 bp, Artificial Sequence
  Synthetic
ggtgcgggtttttttacgttccaggctgatatagttgttcagg

SEQ ID NO: 5253 - DNA, 43 bp, Artificial Sequence
  Synthetic
gtaaaaaaacccgcaccgcgaaagaaaacaaagagctggaaaa

SEQ ID NO: 5254 - DNA, 43 bp, Artificial Sequence
  Synthetic
ttttccagctctttgttttctttcgcggtgcgggtttttttac

SEQ ID NO: 5255 - DNA, 44 bp, Artificial Sequence
  Synthetic
cctgttcaagaaagacatcatcaaaaccattctgccggaatttc

SEQ ID NO: 5256 - DNA, 44 bp, Artificial Sequence
  Synthetic
gaaattccggcagaatggttttgatgatgtctttcttgaacagg

SEQ ID NO: 5257 - DNA, 44 bp, Artificial Sequence
  Synthetic
cctgttcaagaaagacatcatcgcgaccattctgccggaatttc

SEQ ID NO: 5258 - DNA, 44 bp, Artificial Sequence
  Synthetic
gaaattccggcagaatggtcgcgatgatgtctttcttgaacagg

SEQ ID NO: 5259 - DNA, 41 bp, Artificial Sequence
  Synthetic
gccctggtgaatagctttcgtggctttaccaccgcatttac

SEQ ID NO: 5260 - DNA, 41 bp, Artificial Sequence
  Synthetic
gtaaatgcggtggtaaagccacgaaagctattcaccagggc

SEQ ID NO: 5261 - DNA, 42 bp, Artificial Sequence
  Synthetic
ccctggtgaatagctttaatcgttttaccaccgcatttaccg

SEQ ID NO: 5262 - DNA, 42 bp, Artificial Sequence
  Synthetic
cggtaaatgcggtggtaaaacgattaaagctattcaccaggg

SEQ ID NO: 5263 - DNA, 42 bp, Artificial Sequence
  Synthetic
ggctttaccaccgcatttaaaggcttttttgataatcgcgaa

SEQ ID NO: 5264 - DNA, 42 bp, Artificial Sequence
  Synthetic
ttcgcgattatcaaaaaagcctttaaatgcggtggtaaagcc

SEQ ID NO: 5265 - DNA, 52 bp, Artificial Sequence
  Synthetic
gctgcattaatgaaaatctgaccgtgtacattagcaacatggatatctttga

SEQ ID NO: 5266 - DNA, 52 bp, Artificial Sequence
  Synthetic
tcaaagatatccatgttgctaatgtacacggtcagattttcattaatgcagc

SEQ ID NO: 5267 - DNA, 46 bp, Artificial Sequence
  Synthetic
tgaaagtttctatggcgattttgatctggcctatgatattctgctg

SEQ ID NO: 5268 - DNA, 46 bp, Artificial Sequence
  Synthetic
cagcagaatatcataggccagatcaaaatcgccatagaaactttca

SEQ ID NO: 5269 - DNA, 43 bp, Artificial Sequence
  Synthetic
aagccttttttggtgagggccgtgaaaccaatcgtgatgaaag

SEQ ID NO: 5270 - DNA, 43 bp, Artificial Sequence
  Synthetic
ctttcatcacgattggtttcacggccctcaccaaaaaaggctt

SEQ ID NO: 5271 - DNA, 45 bp, Artificial Sequence
  Synthetic
aactgtactttcagaacccgatttttatgggtggttgggataaag

SEQ ID NO: 5272 - DNA, 45 bp, Artificial Sequence
  Synthetic
ctttatcccaaccacccataaaaatcgggttctgaaagtacagtt

SEQ ID NO: 5273 - DNA, 45 bp, Artificial Sequence
  Synthetic
gtgaatggcaactatgaaaaaatccgttacaaactgctgcctggt

SEQ ID NO: 5274 - DNA, 45 bp, Artificial Sequence
  Synthetic
accaggcagcagtttgtaacggattttttcatagttgccattcac

SEQ ID NO: 5275 - DNA, 41 bp, Artificial Sequence
  Synthetic
gcaagaaatggatggcctattttaacccgagcgaggatatt

SEQ ID NO: 5276 - DNA, 41 bp, Artificial Sequence
  Synthetic
aatatcctcgctcgggttaaaataggccatccatttcttgc

SEQ ID NO: 5277 - DNA, 41 bp, Artificial Sequence
  Synthetic
ttcaaagattcaatttcgcgtcatccgaaatggtccaatgc

SEQ ID NO: 5278 - DNA, 41 bp, Artificial Sequence
  Synthetic
gcattggaccatttcggatgacgcgaaattgaatctttgaa

SEQ ID NO: 5279 - DNA, 45 bp, Artificial Sequence
  Synthetic
ctttagcgaaaccgaaaaatacaaaaacattgccggtttttatcg

SEQ ID NO: 5280 - DNA, 45 bp, Artificial Sequence
  Synthetic
cgataaaaaccggcaatgtttttgtatttttcggtttcgctaaag

SEQ ID NO: 5281 - DNA, 43 bp, Artificial Sequence
  Synthetic
gttttagcgaggatcagtatcagctgcatatcccgattgccat

SEQ ID NO: 5282 - DNA, 43 bp, Artificial Sequence
  Synthetic
atggcaatcgggatatgcagctgatactgatcctcgctaaaac

SEQ ID NO: 5283 - DNA, 46 bp, Artificial Sequence
  Synthetic
aggatcagtatgaactgcatatcgtgattgccatcaataaatgccc

SEQ ID NO: 5284 - DNA, 46 bp, Artificial Sequence
  Synthetic
gggcatttattgatggcaatcacgatatgcagttcatactgatcct

SEQ ID NO: 5285 - DNA, 44 bp, Artificial Sequence
  Synthetic
cccgaaaaacatctttaagatcaacaaagaagttcgcgtgctgc

SEQ ID NO: 5286 - DNA, 44 bp, Artificial Sequence
  Synthetic
gcagcacgcgaacttctttgttgatcttaaagatgtttttcggg

SEQ ID NO: 5287 - DNA, 47 bp, Artificial Sequence
  Synthetic
cgtggtgaacgtaacctgttttatattgttgttgttgatggtaaagg

SEQ ID NO: 5288 - DNA, 47 bp, Artificial Sequence
  Synthetic
cctttaccatcaacaacaacaatataaaacaggttacgttcaccacg

SEQ ID NO: 5289 - DNA, 44 bp, Artificial Sequence
  Synthetic
gtgaacgtaacctgctgtatgcggttgttgttgatggtaaaggc

SEQ ID NO: 5290 - DNA, 44 bp, Artificial Sequence
  Synthetic
gcctttaccatcaacaacaaccgcatacagcaggttacgttcac

SEQ ID NO: 5291 - DNA, 47 bp, Artificial Sequence
  Synthetic
gtggaacagtatagtctgaacgtgattatcaacaactttaacggcat

SEQ ID NO: 5292 - DNA, 47 bp, Artificial Sequence
  Synthetic
atgccgttaaagttgttgataatcacgttcagactatactgttccac

SEQ ID NO: 5293 - DNA, 43 bp, Artificial Sequence
  Synthetic
agtatagtctgaacgaaattcgtaacaactttaacggcatccg

SEQ ID NO: 5294 - DNA, 43 bp, Artificial Sequence
  Synthetic
cggatgccgttaaagttgttacgaatttcgttcagactatact

SEQ ID NO: 5295 - DNA, 48 bp, Artificial Sequence
  Synthetic
gttttgaagcacgtcagaacgcgaccagtattgaaaacatcaaagaac

SEQ ID NO: 5296 - DNA, 48 bp, Artificial Sequence
  Synthetic
gttctttgatgttttcaatactggtcgcgttctgacgtgcttcaaaac

SEQ ID NO: 5297 - DNA, 43 bp, Artificial Sequence
  Synthetic
ccagtattgaaaacatcaaaaacctgaaagccggttatattag

SEQ ID NO: 5298 - DNA, 43 bp, Artificial Sequence
  Synthetic
ctaatataaccggctttcaggtttttgatgttttcaatactgg

SEQ ID NO: 5299 - DNA, 47 bp, Artificial Sequence
  Synthetic
ctgaaagccggttatattagctttgtggttcataaaatctgtgagct

SEQ ID NO: 5300 - DNA, 47 bp, Artificial Sequence
  Synthetic
agctcacagattttatgaaccacaaagctaatataaccggctttcag

SEQ ID NO: 5301 - DNA, 43 bp, Artificial Sequence
  Synthetic
gttatattagccaggtggttaaaaaaatctgtgagctggtaga

SEQ ID NO: 5302 - DNA, 43 bp, Artificial Sequence
  Synthetic
tctaccagctcacagatttttttaaccacctggctaatataac

SEQ ID NO: 5303 - DNA, 48 bp, Artificial Sequence
  Synthetic
ccaggtggttcataaaatctgtcgtctggtagaaaaatacgatgcagt

SEQ ID NO: 5304 - DNA, 48 bp, Artificial Sequence
  Synthetic
actgcatcgtatttttctaccagacgacagattttatgaaccacctgg

SEQ ID NO: 5305 - DNA, 50 bp, Artificial Sequence
  Synthetic
aaaggttatcagattaccaacaaatttgtgagctttaaaagcatgagcac

SEQ ID NO: 5306 - DNA, 50 bp, Artificial Sequence
  Synthetic
gtgctcatgcttttaaagctcacaaatttgttggtaatctgataaccttt

SEQ ID NO: 5307 - DNA, 45 bp, Artificial Sequence
  Synthetic
aacctgctgaaaacaaaatataccgaaattgccgacagcaagaag

SEQ ID NO: 5308 - DNA, 45 bp, Artificial Sequence
  Synthetic
cttcttgctgtcggcaatttcggtatattttgttttcagcaggtt

SEQ ID NO: 5309 - DNA, 44 bp, Artificial Sequence
  Synthetic
ctgtgtgaacagagcgatgatgcgttttatagcagttttatggc

SEQ ID NO: 5310 - DNA, 44 bp, Artificial Sequence
  Synthetic
gccataaaactgctataaaacgcatcatcgctctgttcacacag

SEQ ID NO: 5311 - DNA, 42 bp, Artificial Sequence
  Synthetic
agccgcaattacgaagcagatgaaaatgcaattctgccgaaa

SEQ ID NO: 5312 - DNA, 42 bp, Artificial Sequence
  Synthetic
tttcggcagaattgcattttcatctgcttcgtaattgcggct

SEQ ID NO: 5313 - DNA, 57 bp, Artificial Sequence
  Synthetic
cgttttagcgaggatcagtatcagctgcatatcgtgattgccatcaataaatgcccg

SEQ ID NO: 5314 - DNA, 57 bp, Artificial Sequence
  Synthetic
cgggcatttattgatggcaatcacgatatgcagctgatactgatcctcgctaaaacg

SEQ ID NO: 5315 - RNA, 44 nt, Artificial Sequence
  Synthetic
uaauuucuacuaaguguagauaacacacccaaggaaagacuaug

SEQ ID NO: 5316 - RNA, 44 nt, Artificial Sequence
  Synthetic
uaauuucuacuaaguguagauauagucuuuccuuggguguguua

SEQ ID NO: 5317 - RNA, 44 nt, Artificial Sequence
  Synthetic
uaauuucuacuaaguguagauauccgugcugaguguaccaugca

SEQ ID NO: 5318 - RNA, 44 nt, Artificial Sequence
  Synthetic
uaauuucuacuaaguguagauuuguaggauaugcccuugacuau

SEQ ID NO: 5319 - DNA, 27 bp, Artificial Sequence
  Synthetic
aagaatgttgtgataaaaggtgatgct

SEQ ID NO: 5320 - DNA, 24 bp, Artificial Sequence
  Synthetic
acacatccatgggacttctgcctc
